United States Patent
SÆtrom

(10) Patent No.: US 10,633,659 B2
(45) Date of Patent: Apr. 28, 2020

(54) C/EBPα SHORT ACTIVATING RNA COMPOSITIONS AND METHODS OF USE

(71) Applicant: MINA THERAPEUTICS LIMITED, London (GB)

(72) Inventor: PÅL SÆtrom, Trondheim (NO)

(73) Assignee: MiNA THERAPEUTICS LIMITED, London (GB)

( * ) Notice: Subject to any disclaimer, the term of this patent is extended or adjusted under 35 U.S.C. 154(b) by 0 days.

(21) Appl. No.: 16/224,863

(22) Filed: Dec. 19, 2018

(65) Prior Publication Data

US 2019/0249176 A1   Aug. 15, 2019

Related U.S. Application Data

(63) Continuation of application No. 15/038,332, filed as application No. PCT/IB2014/003054 on Nov. 24, 2014, now Pat. No. 10,202,601.

(60) Provisional application No. 61/907,732, filed on Nov. 22, 2013.

(51) Int. Cl.

| | |
|---|---|
| C12N 15/11 | (2006.01) |
| A61K 48/00 | (2006.01) |
| C07H 21/02 | (2006.01) |
| C07H 21/04 | (2006.01) |
| C12N 15/113 | (2010.01) |
| A61K 47/54 | (2017.01) |
| A61K 47/64 | (2017.01) |
| A61K 31/7105 | (2006.01) |
| A61K 45/06 | (2006.01) |

(52) U.S. Cl.
CPC ........ *C12N 15/113* (2013.01); *A61K 31/7105* (2013.01); *A61K 45/06* (2013.01); *A61K 47/549* (2017.08); *A61K 47/64* (2017.08); *C12N 15/1135* (2013.01); *C12N 2310/11* (2013.01); *C12N 2310/113* (2013.01)

(58) Field of Classification Search
CPC .............. C12N 15/113; C12N 15/1135; C12N 2310/11; C12N 2310/113; A61K 47/549
See application file for complete search history.

(56) References Cited

U.S. PATENT DOCUMENTS

| | | |
|---|---|---|
| 6,306,655 B1 | 10/2001 | Monia et al. |
| 7,709,456 B2 | 5/2010 | Corey et al. |
| 8,193,330 B2 | 6/2012 | German |
| 8,324,181 B2 | 12/2012 | Corey et al. |
| 8,357,666 B2 | 1/2013 | Eilertsen et al. |

(Continued)

FOREIGN PATENT DOCUMENTS

| | | |
|---|---|---|
| EP | 2363467 | 9/2011 |
| JP | 2007082430 A | 4/2007 |

(Continued)

OTHER PUBLICATIONS

Maria Hatziapostolou et al: "An HNF4-miRNA Inflammatory Feedback Circuit Regulates Hepatocellular Oncogenesis", Cell, Cell Press, US, vol. 147, No. 6, Oct. 11, 2011 (Oct. 11, 2011), pp. 1233-1247.

(Continued)

*Primary Examiner* — Terra C Gibbs
(74) *Attorney, Agent, or Firm* — DT Ward, PC; Donna T. Ward; Heng Zhu

(57) ABSTRACT

The invention relates to saRNA targeting a C/EBPα transcript and therapeutic compositions comprising said saRNA. Methods of using the therapeutic compositions are also provided.

11 Claims, 54 Drawing Sheets

Specification includes a Sequence Listing.

Primary effects of C/EBPα on the liver

(56) References Cited

U.S. PATENT DOCUMENTS

| | | |
|---|---|---|
| 8,785,184 B2 | 7/2014 | Xu |
| 8,877,721 B2 | 11/2014 | Li et al. |
| 9,328,346 B2 | 5/2016 | Lee et al. |
| 2009/0269763 A1 | 10/2009 | Eilertsen et al. |

FOREIGN PATENT DOCUMENTS

| | | |
|---|---|---|
| JP | 2007-082430 A | 5/2007 |
| JP | 2008-538896 | 11/2008 |
| WO | 2004/045543 | 6/2004 |
| WO | 2006/113246 | 10/2006 |
| WO | 2007/086990 | 8/2007 |
| WO | 2007/087113 | 8/2007 |
| WO | 2008/109449 | 9/2008 |
| WO | 2008/109556 | 9/2008 |
| WO | 2008/150814 | 12/2008 |
| WO | 2009/046397 | 4/2009 |
| WO | 2009/086428 | 7/2009 |
| WO | 2009/126250 | 10/2009 |
| WO | 2009/126927 | 10/2009 |
| WO | 2010/047216 | 4/2010 |
| WO | 2010/057045 | 5/2010 |
| WO | 2010/108126 | 9/2010 |
| WO | 2010/135329 | 11/2010 |
| WO | 2010/151755 | 12/2010 |
| WO | 2011/085066 | 7/2011 |
| WO | 2011/161460 | 12/2011 |
| WO | 2012/046084 | 4/2012 |
| WO | 2012/046085 | 4/2012 |
| WO | 2012/170771 | 12/2012 |
| WO | 2012/175958 A1 | 12/2012 |
| WO | 2012175958 A1 | 12/2012 |
| WO | 2013/090648 | 6/2013 |

OTHER PUBLICATIONS

Shi Yi-Chao et al: "C/EBP[alpha] inhibits hepatocellular carcinoma by reducing Notch3/Hes1/p27 casc", Digestive and Liver Disease, vol. 45, No. 10, Jun. 28, 2013 (Jun. 28, 2013), pp. 844.851.

Wang X et al: "Over-expression of C/EBP-alpha induces apoptosis in cultured rat hepatic stellate cells depending on p53 and peroxisome proliferator-activated receptor-gamma", Biochemical and Biophysical Research Communications, Academic Press Inc. Orlando, FL, US, vol. 380, No. 2, Mar. 6, 2009 (Mar. 6, 2009), pp. 286-291.

P. Dhawan et al: "CCAAT Enhancer-binding Protein Is a Molecular Target of 1, 25-Dihydroxyvitamin D3 in MCF-7 Breast Cancer Cells", Journal of Biological Chemistry, vol. 284, No. 5, Jan. 1, 2008 (Jan. 1, 2008), pp. 3086-3095.

Li-Li Tao et al: "C/EBP–I+- ameliorates CC1-induced liver fibrosis in mice through promoting apoptosis of hepatic stellate cells with little apoptotic effect on hepatocytes in vitro and in vivo", Apoptosis; An International Journal on Programmed Cell Death, Kluwer Academic Publishers, BO, vol. 17, No. 5, Feb. 4, 2012 (Feb. 4, 2012), pp. 492-502.

International Search Report and Written Opinion dated Aug. 26, 2015 in Application No. PCT/IB2014/003054, entitled: C/EBP Alpha Compositions and Methods of Use.

Zhou et al., "Systemic Administration of Combinatorial dsiRNAs via Nanoparticles Efficiently Suppresses HIV-1 Infection in Humanized Mice" Molecular Ther. 2011 vol. 19, p. 2228-2238.

Morris, K. et al. Bidirectional transcription directs both transcriptional gene activation and suppression in human cells, PLOS Genetics, 2008, vol. 4, No. 11, p. E1000258.

Long-Cheng, L. et al., Small dsRNAs induce transcriptional activation in human cells, Proceedings of the National Academy of Sciences USA, 2006, vol. 103, No. 46, pp. 17337-17342.

Schwartz, J. et al., Antisense transcripts are targets for activating small RNAs, Nature Structural & Molecular Biology, 2008, vol. 15, No. 8, pp. 842-848.

Place, R. et al. MicroRNA-373 induces expression of genes with complementary promoter sequences, Proceedings of the National Academy of Sciences USA, 2008, vol. 105, No. 5, pp. 1608-1613.

Xu, N. et al. MicroRNA-145 regulates OCT4, SOX2, and KLF4 and represses pluripotency in human embryonic stem cells, Cell, 2009, vol. 137, No. 4, pp. 647-658.

Janowski, B. et al. Activating gene expression in mammalian cells with promoter-targeted duplex RNAs, Nature Chemical Biology, 2007, vol. 3, No. 3, pp. 166-173.

Elmen, J., et al. Antagonism of microRNA-122 in mice by systemically administered LNA-antimiR leads to up-regulation of a large set of predicted target mRNAs in the liver, Nucleic Acids Research, 2007, vol. 36, No. 4, pp. 1153-1162.

Tian, Y. et al., MicroRNA-10b promotes migration and invasion through KLF4 in human esophageal cancer cell lines, Journal of Biological Chemistry, 2010, vol. 285, No. 11, pp. 7986-7994.

Napoli, S., et al. Promoter-specific transcriptional interference and c-myc gene silencing by siRNAs in human cells, The EMBO Journal, 2009, vol. 28, No. 12, pp. 1708-1719.

Wahlestedt, C., et al. Natural antisense and noncoding RNA transcripts as potential drug targets, Drug Discovery Today, 2006, vol. 11, No. 11/12, pp. 503-508.

International Search Report for PCT/GB2011/051185, dated Dec. 19, 2011.

Search Report dated May 16, 2011, from the UK Patent Office in corresponding Application No. GB1010557.5.

Li, Y. et al., miR-375 enchances palmitate-induced lipoapoptosis in insulin-secreting NIT-1 cells by repressing myotrophin (V1) protein expression, International Journal of Clinical and Experimental Pathology, 2010, vol. 3, No. 3, pp. 254-264.

Tang, X. et al., Role of microRNAs in diabetes, Biochimica et Biophysica Acta, 2008, vol. 1779, No. 1, pp. 697-701.

Place, R. et al., Defining features and exploring chemical modifications to manipulate RNAa activity, Current Pharmaceutical Biotechnology, 2010, vol. 11, No. 5, pp. 518-526.

International Search Report for PCT/GB2011/051942, dated Feb. 15, 2012.

International Search Report for PCT/GB2011/051940, dated Jul. 18, 2012.

Dhawan, P. et al. CCAA T Enhancer-Binding Protein is a molecular target of 1,25-Dihydroxyvitamin 03 in MCF-7 breast cancer cells. J. Biol. Chem. 2008. 284(5):3086-3095.

Chen, Y. et al. Transplantation of human hepaticytes cultured and deleted variant of hepatocyte growth factor prolongs the survival of mice with acute liver failure. Transplanation. 2005. 79(10):1378-1385.

Ishiyama, T. et al. Expression of HNFs and C/EBP alpha is correlated with immunocytochemical differentiation of cell lines derived from human hepatocellular carcinomas, hepatoblastomas and immortalized hepatocytes. Cancer Science. 2003. 94(9):757-763.

Kratz, F. Albumin, a versatile carrier in oncology. Inn J. Clin. Pharm. Ther. 2010. 48(7):453-455.

Madhorta, R. et al. Recent developments in the treatment of alcohol hepatitis. Monthly J. Assoc. Physicians. 2003. 96(6):391-400.

McCormick, P.A. et al., Intravenous albumin infusion is an effective therapy for hyponatraemia in cirrhotic patients with ascites. Gut. 31(2):204-207.

International Search Report and Written Opinion for PCT/GB2012/051422, dated Sep. 26, 2012.

Gery, Sigal et al. "Clin Cancer Res", 2005, vol. 11, No. 9, May 1, 2005, p. 3184-3190.

Wang, Guo-Li et al. "Exp Cell Res", Apr. 15, 2008, vol. 314, No. 7, p. 1626-1639.

Office Action dated Mar. 9, 2016 received in corresponding Japanese application No. 2014-516440.

Homma et al. "Increased expression of CCAAT/enhancer binding protein β correlates with prognosis in glioma patients", Oncology Reports 15: 595-601, 2006.

De Guire et al. "Designing small multiple-target artificial RNAs", Nucleic Acids Research, 2010, vol. 38, No. 13, pp. 1-8.

Written Opinion dated Jul. 3, 2017 in corresponding Singapore Application No. 11201604012Y.

(56) References Cited

OTHER PUBLICATIONS

Examination Report received in corresponding EP application No. 14843226.3 dated Dec. 21, 2017.
Second Written Opinion dated Apr. 26, 2018 in corresponding Singapore Application No. 11201604012Y.
SiersÆk, R. et al., "PPARγ in adipocyte differentiation and metabolism—Novel insights from Genome-wide studies" (2010) FEB Letters 584(15):3242-3249.
Communication pursuant to Article 94(3) EPC dated Jul. 10, 2018 in co-pending European Application No. 14843226.3, entitled "C/EBP Alpha Short Activating Compositions and Methods of Use".
Office Action dated Aug. 7, 2018 in co-pending Japanese Application No. 2016-53359, entitled "C/EBP Alpha Short Activating Compositions and Methods of Use".
Fineberg, H.V. MD, PhD "The Paradox of Disease Prevention Celebrated in Principle, Resisted in Practice" (2013) JAMA 310(1):85-90.
Office Action dated Mar. 19, 2019 in corresponding Japanese application No. 2016-533569 entitled, "C/EBP Alpha Short Activating RNA Compositions and Methods of Use".
Shi, Y.-C., et al., C/EBPα inhibits hepatocellular carsinoma by reducing Notch3/Hes1/p27 cascades (2013) Digestive and Liver Disease 45:844-854.
Office Action dated Oct. 30, 2019 in corresponding Chinese application No. 21480073877.1 entitled, "C/EBP Alpha Short Activating RNA Compositions and Methods of Use".
Hatziapostolou, M. et al., "An HNF4α-miRNA Inflammatory Feedback Circuit Regulates Hepatocellular Oncogenesis" (2011) Cell 147:1233-1247.
Shunsuke Nojiri et al., "Albumin Suppresses Human Hepatocellular Carcinoma Proliferation and the Cell Cycle", International Journal of Molecular Sciences, vol. 15, No. 3, Mar. 24, 2014 (Mar. 24, 2014), pp. 5163-5174.
Shi, Y.-C., et al., C/EBPa inhibits hepatocellular carsinoma by reducing Notch3/Hes1/p27 cascades (2013) Digestive and Liver Disease 45:844-854.
I Paz-Priel et al: "C/EBP[alpha] or C/EBP[alpha] oncoproteins regulate the intrinsic and extrinsic apoptotic pathways by direct interation with NF-[kappa]B p50 bound to the bcl-2 and FLIP gene promoters", Leukemia, vol. 23, No. 2, Nov. 6, 2008 (Nov. 6, 2008), pp. 365-374.
L.M. Johansen et al: "c-Myc Is a Critical Target for C/EBP in Granulopoiesis", Molecular and Cellular Biology, vol. 21, No. 11, Jun. 1, 2001 (Jun. 1, 2001) pp. 3789-3806.
Dhawan, R. et la., "CCAAT Enhancer-binding Protein α Is a Molecular Target of 1,25-Dihydroxyvitamin D3 in MCF-7 Breast Cancer Cells*" (2009) Journal of Biological Chemistry 284(5):3086-3095.

Pooja Pal et al: "Ectopic expression of hC/EBPs in breast tumor cells induces apoptosis", Molecular and Cellular Biochemistry, Kluwer Academic Publishers, BO, vol. 337, No. 1-2, Oct. 23, 2009 (Oct. 23, 2009) pp. 111-118.
Polina Iakova et al: "Intracellulcar signaling and hepatocellular carcinoma", Seminars in Cancer Biology, vol. 21, No. 1, 2011, pp. 28-34.
Vikash Reebye et al: "Novel RNA oligonucleotide improves liver function and inhibits liver carcinogenesis in vivo", Hepatology, vol. 59, No. 1, Dec. 9, 2013 (Dec. 9, 2013), pp. 216-227.
Dowell p. et al: "C/EBPalpha reverses the anti-adipogenic effects of the HIV protease inhibitor nelfinavir", Biochemical and Biophysical Research Communications, Academic Press Inc. Orlando, FL, US, vol. 327, No. 1, Feb. 11, 2005 (Feb. 11, 2005), pp. 571-574.
Li-Li Tao et al: "C/EBP-l+- ameliorates CC1-induced liver fibrosis in mice through promoting apoptosis of hepatic stellate cells with little apoptotic effect on hepatocytes in vitro and in vivo", Apoptosis; An International Journal on Programmed Cell Death, Kluwer Academic Publishers, BO, vol. 17, No. 5, Feb. 4, 2012 (Feb. 4, 2012), pp. 492-502.
Shuang Mei et al: "In vivo transfection of C/EBP-? gene could ameliorate CCL 4-induced hepatic fibrosis in mice", Hepatology Research, vol. 37, No. 7, Jul. 1, 2007 (Jul. 1, 2007), pp. 531-539.
S. Yogosawa et al: "Activin Receptor-Like Kinase 7 Suppresses Lipolysis to Accumulate Fat in Obesity Through Downregulation of Peroxisome Proliferator-Activated Receptor and C/EBP", Diabetes, vol. 62, No. 1, Aug. 28 2012 (Aug. 28 2012), pp. 115-123.
Louise E. Olofsson et al: "CCAAT/Enhancer Binding Protein [alpha] (C-EBP[alpha]) in Adipose Tissue Regulates Genes in Lipid and Glucose Metabolism and a Genetic Variation of C/EBP[alpha] Is Associated with Serum Levels of Triglycerides", Journal of Clinical Endocrinology & Metabolism, vol. 93, No. 12, Dec. 1, 2008 (Dec. 1, 2008), pp. 4880-4886.
Siers/EK, R. et al, "PPARγ in adipocyte differentiation and metabolism—Novel insights from Genome-wide studies" (2010) FEB Letters 584(15):3242-3249.
Tan, C.K. et al., "Smad3 Deficiency in Mice Protects Against Insulin Resistance and Obesity Induced by a High-Fat Diet" (2011) Diabetes 60(2):464-476.
Wu, Z. et al., "Cross-Regulation of C/EBP[alpha] and PPAR[gamma] Controls the Transcriptional Pathway of Adipogenesis and Insulin Sensitivity" (1999) Molecular Cell 3:151-158.
Extended European Search Report issued Dec. 10, 2019 in corresponding European application No. 1910263.4 entitled, "C/EBP Alpha Short Activating Compositions and Methods of Use".
Examination Report No. 1 for standard patent application issued Dec. 23, 2019 in corresponding Australia application No. 2014351482 entitled, "C/EBP Alpha Short Activating Compositions and Methods of use".

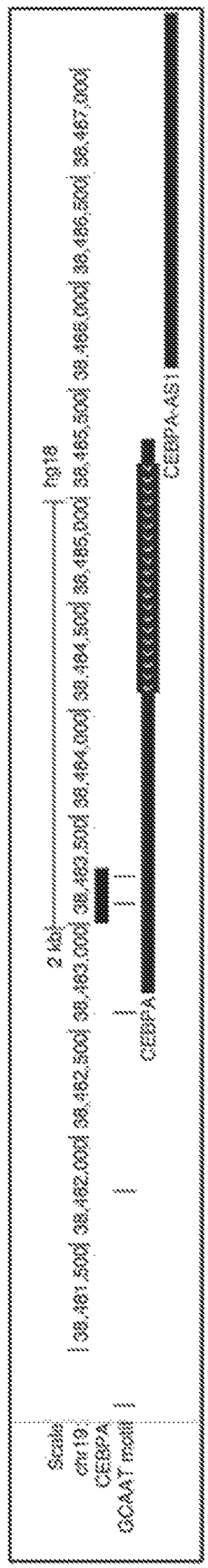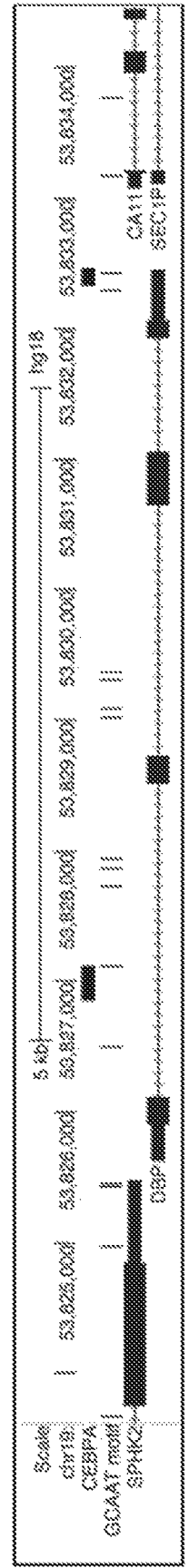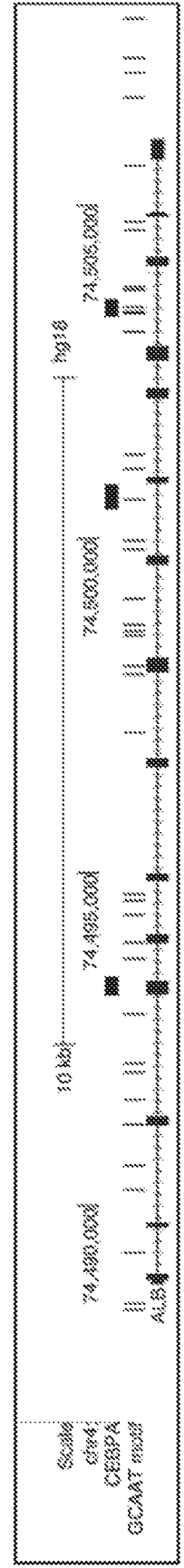
Fig. 3E
Fig. 3F
Fig. 3G

Fig. 10

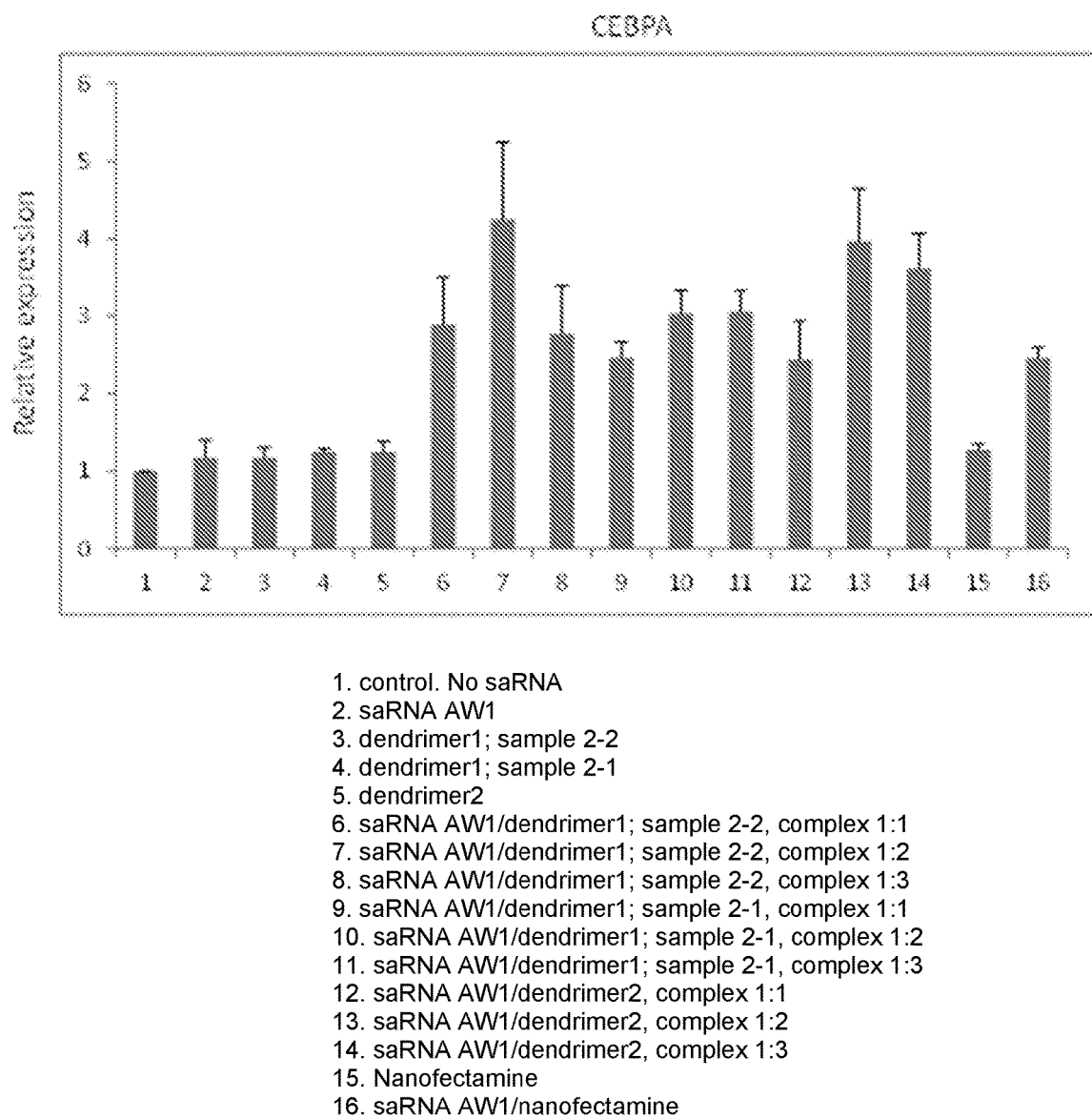

1. control. No saRNA
2. saRNA AW1
3. dendrimer1; sample 2-2
4. dendrimer1; sample 2-1
5. dendrimer2
6. saRNA AW1/dendrimer1; sample 2-2, complex 1:1
7. saRNA AW1/dendrimer1; sample 2-2, complex 1:2
8. saRNA AW1/dendrimer1; sample 2-2, complex 1:3
9. saRNA AW1/dendrimer1; sample 2-1, complex 1:1
10. saRNA AW1/dendrimer1; sample 2-1, complex 1:2
11. saRNA AW1/dendrimer1; sample 2-1, complex 1:3
12. saRNA AW1/dendrimer2, complex 1:1
13. saRNA AW1/dendrimer2, complex 1:2
14. saRNA AW1/dendrimer2, complex 1:3
15. Nanofectamine
16. saRNA AW1/nanofectamine

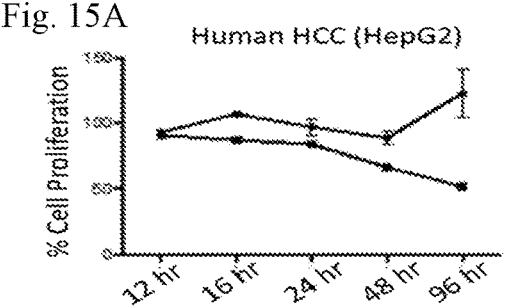
Fig. 15A
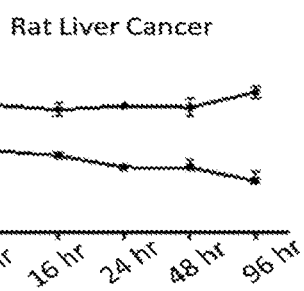
Fig. 15B
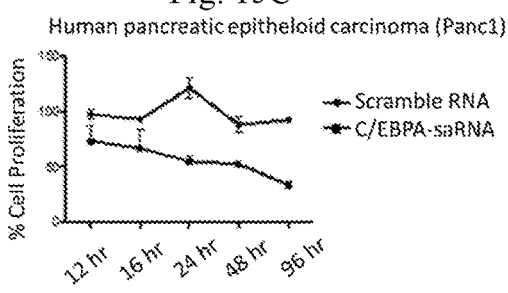
Fig. 15C
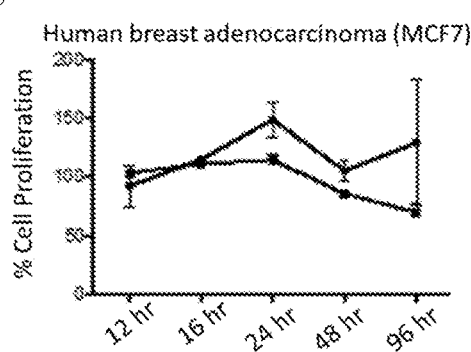
Fig. 15D
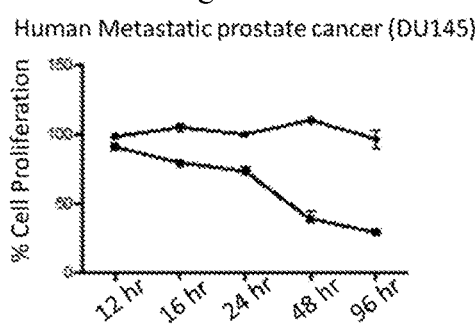
Fig. 15E
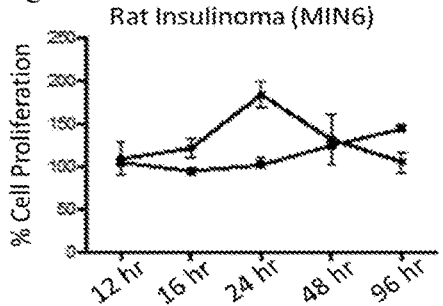
Fig. 15F
Fig. 16
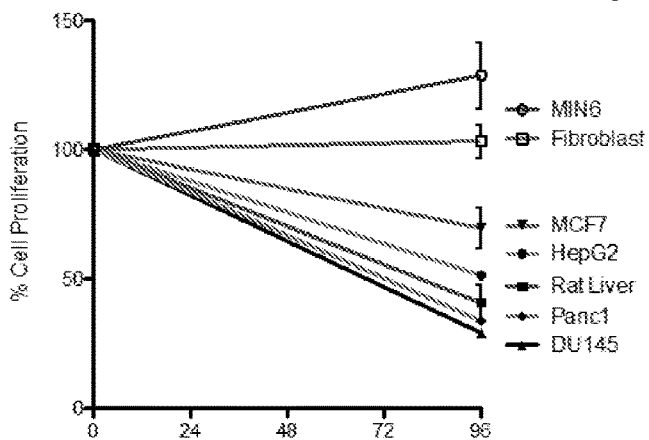
| Cell line | % Cell death |
|---|---|
| MIN6 (Rat Insulinoma) | 0% |
| Fibroblast | 0% |
| MCF7 (ER +ve Human breast cancer) | 31% |
| HepG2 (Human HCC) | 50% |
| Rat Liver | 59% |
| Panc1 (Human Pancreatic Carcinoma) | 66% |
| DU145 (Human metastatic Prostate Cancer) | 71% |

A. Cholesterol

B. Low density lipoprotein

Fig. 24
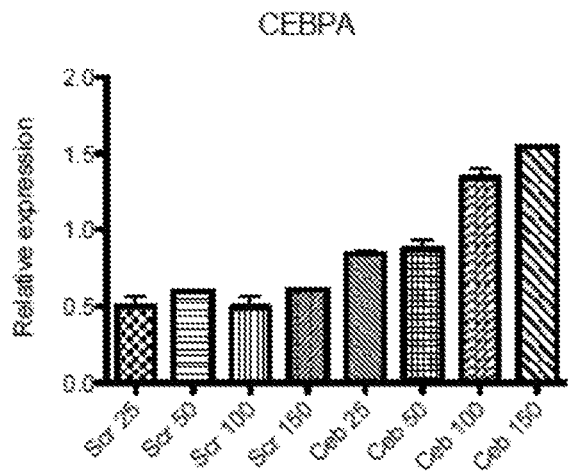
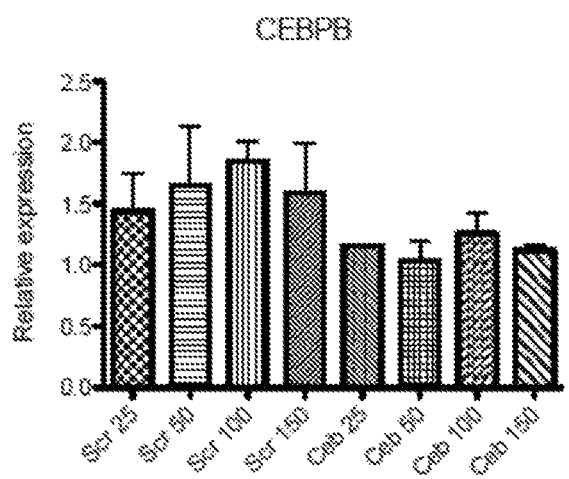
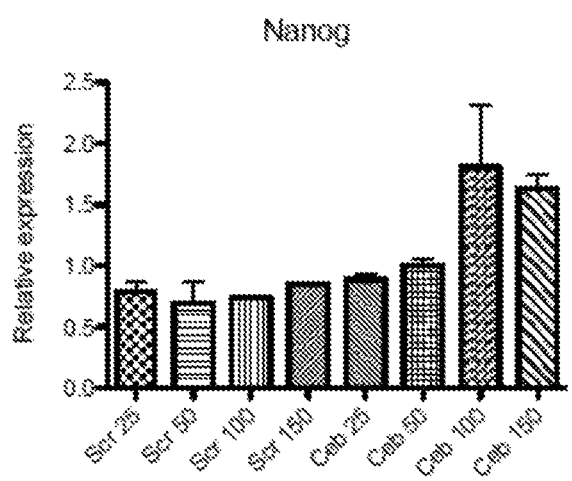

Fig. 25
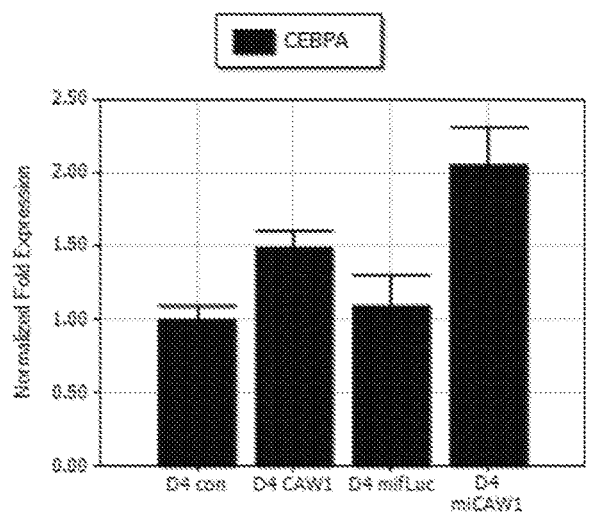
Fig. 26
CEBPA-AW1 miRNA insert sequence
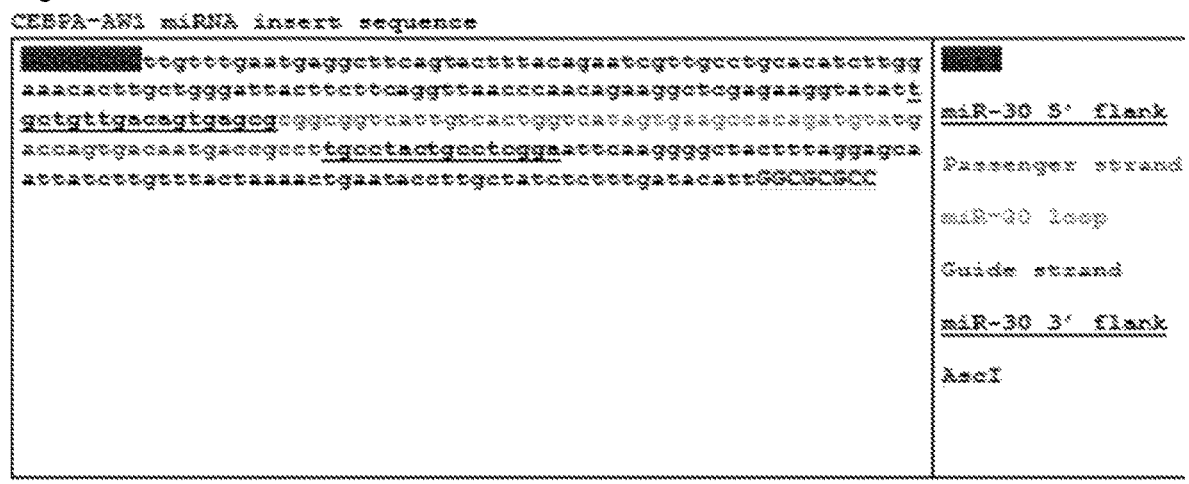
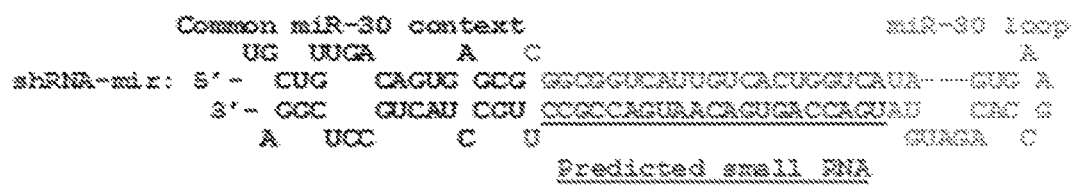

Child A Undifferentiated (~ 10%) treat with CEPA alpha
All Child A, B, C, undifferentiated (40%) treat with CEPA + HNF4
All HCC (100%) treat with CEPA + Beta + HNF4

-------------------------------------------------

Fatty liver treat with CEBPA
liver failure treat with HNF4

Fig. 39A
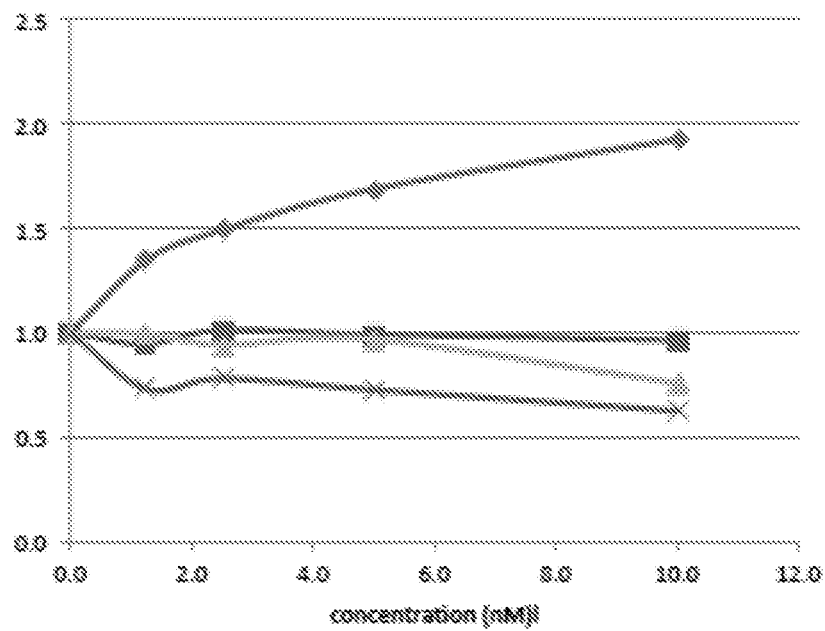
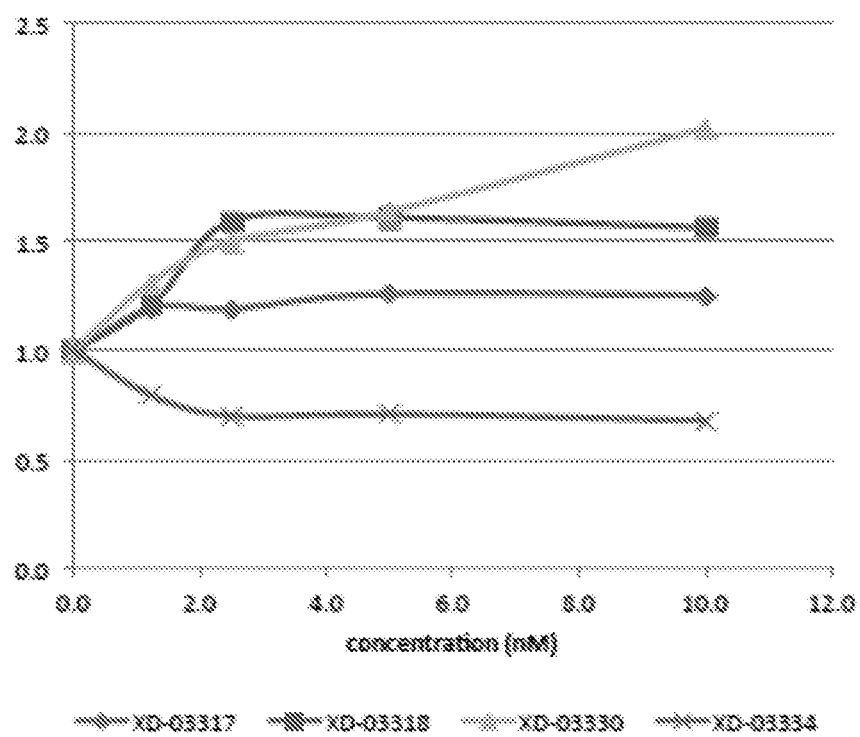

Fig. 39B
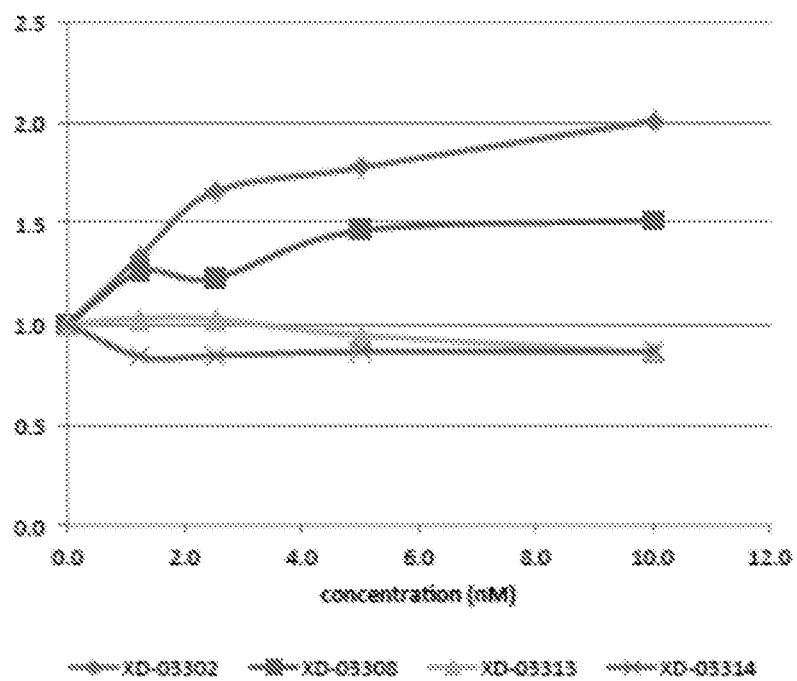
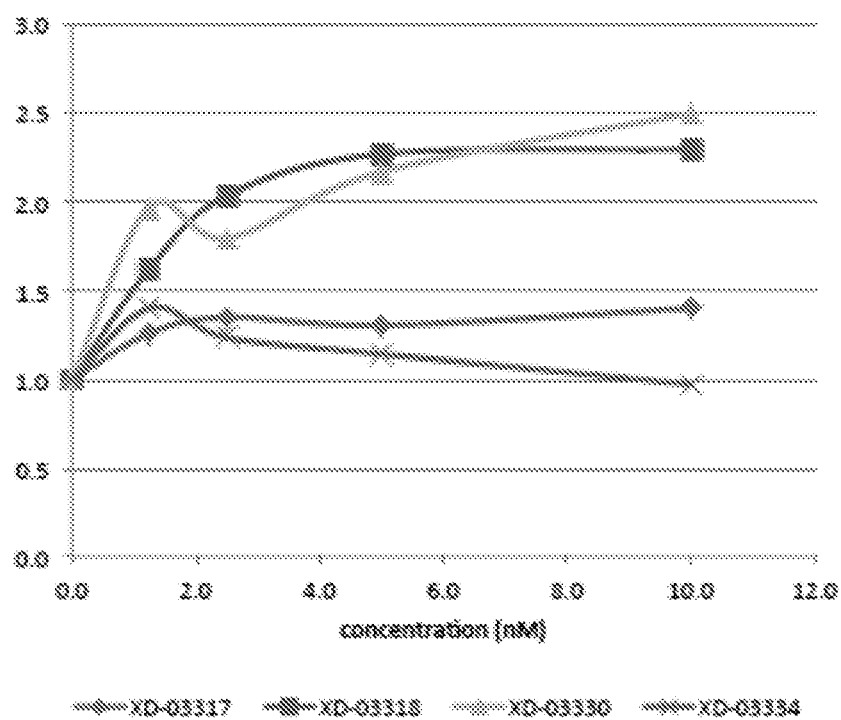

Fig. 39C
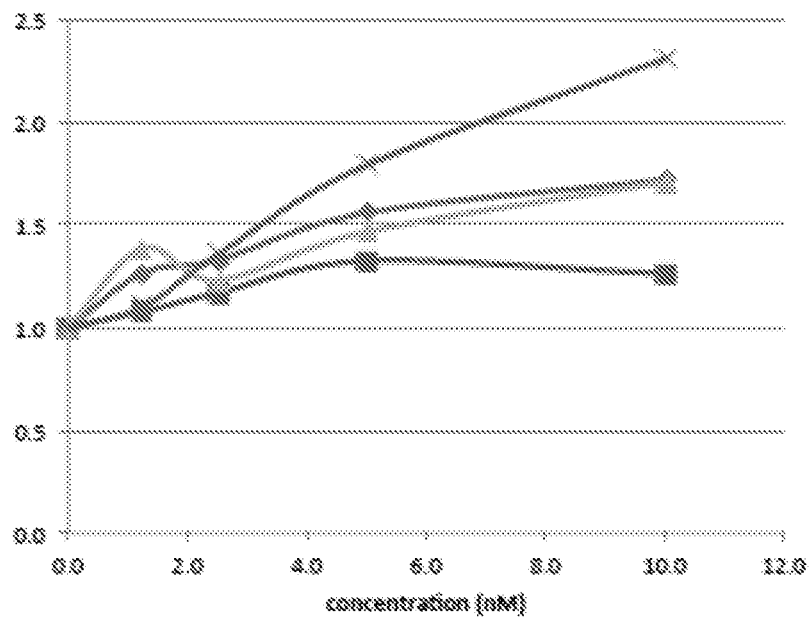
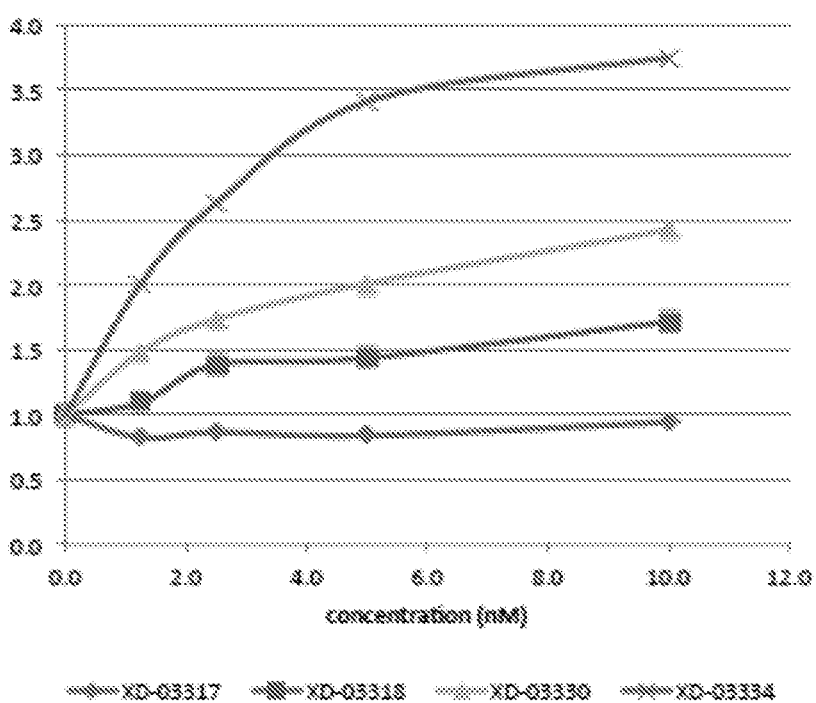

Fig. 39D
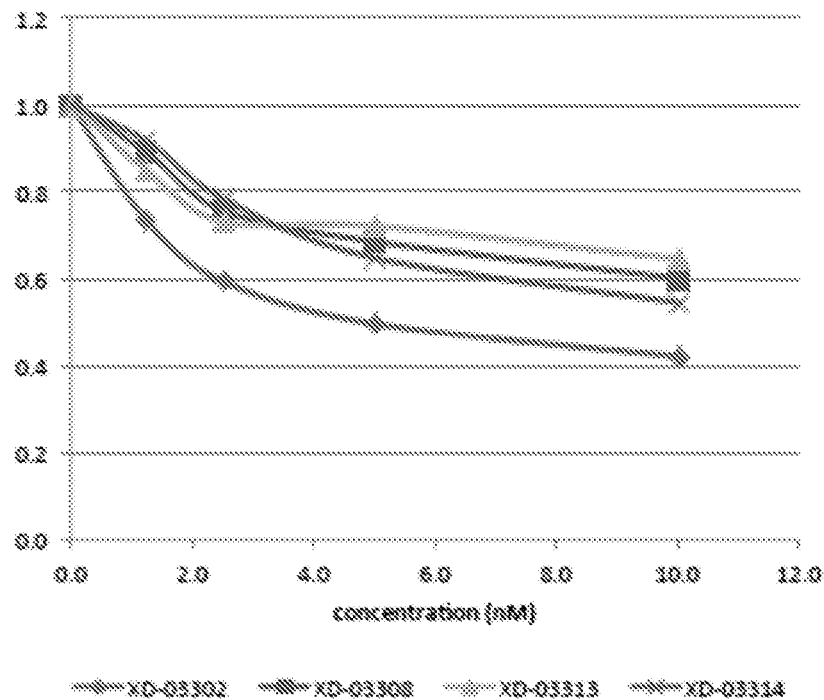
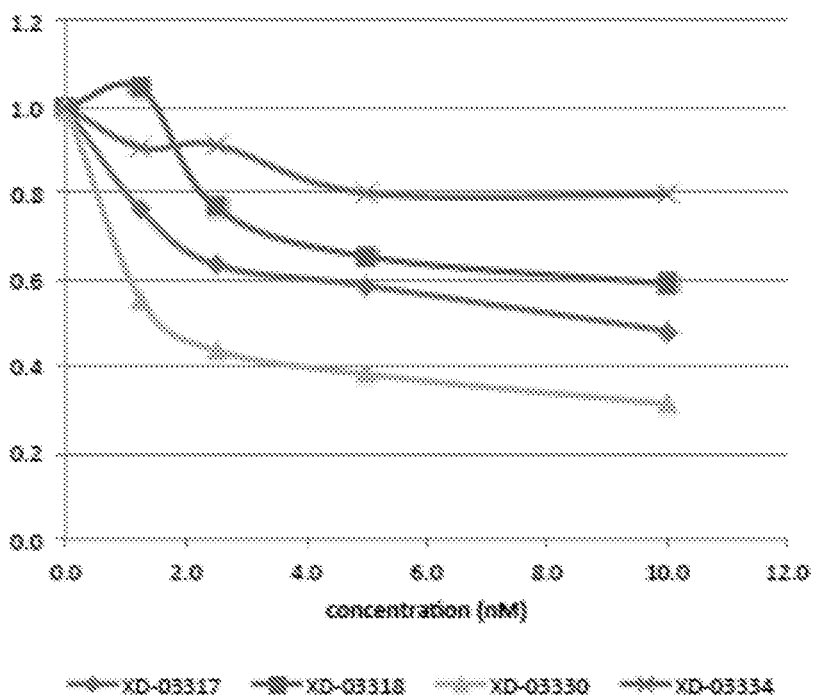

Fig. 39E
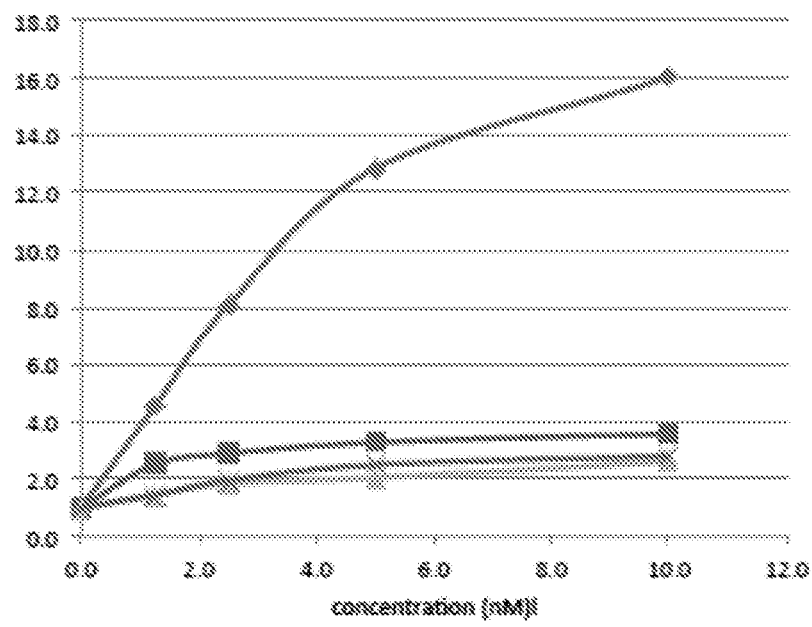
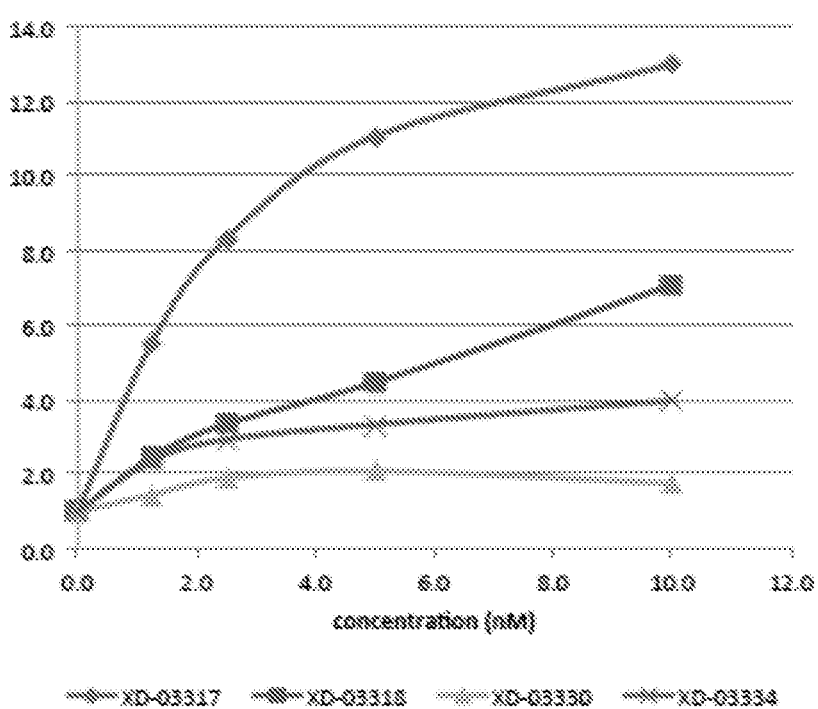

Fig. 39F
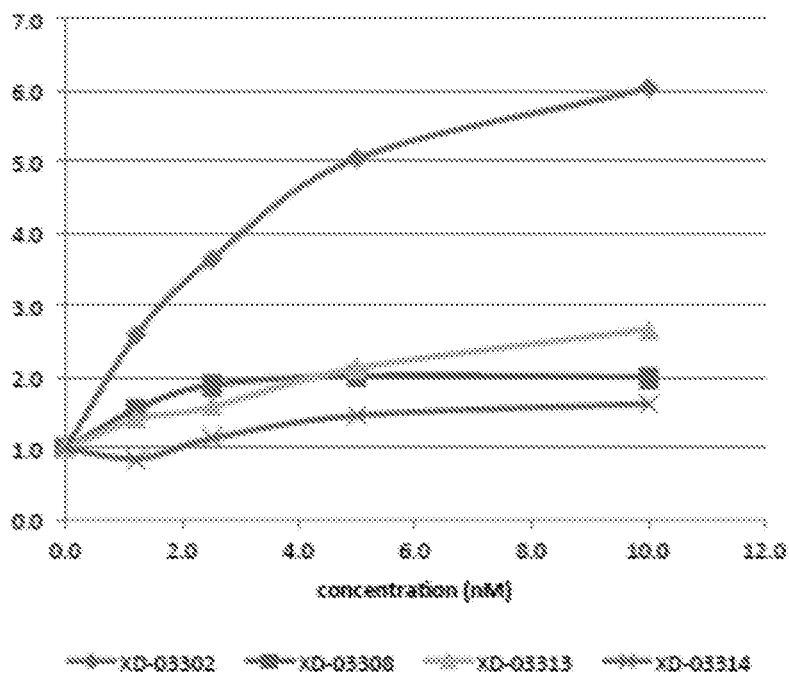
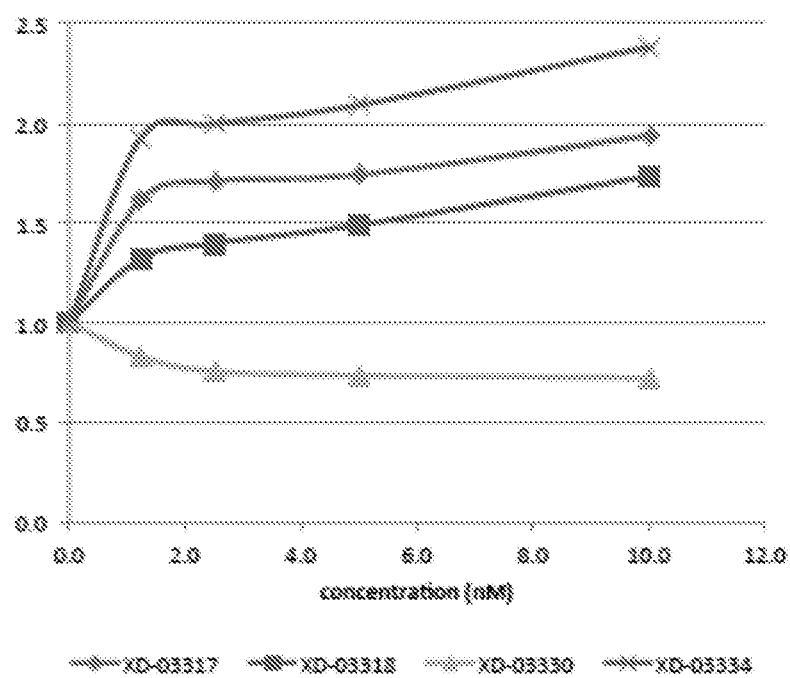

Fig. 39G
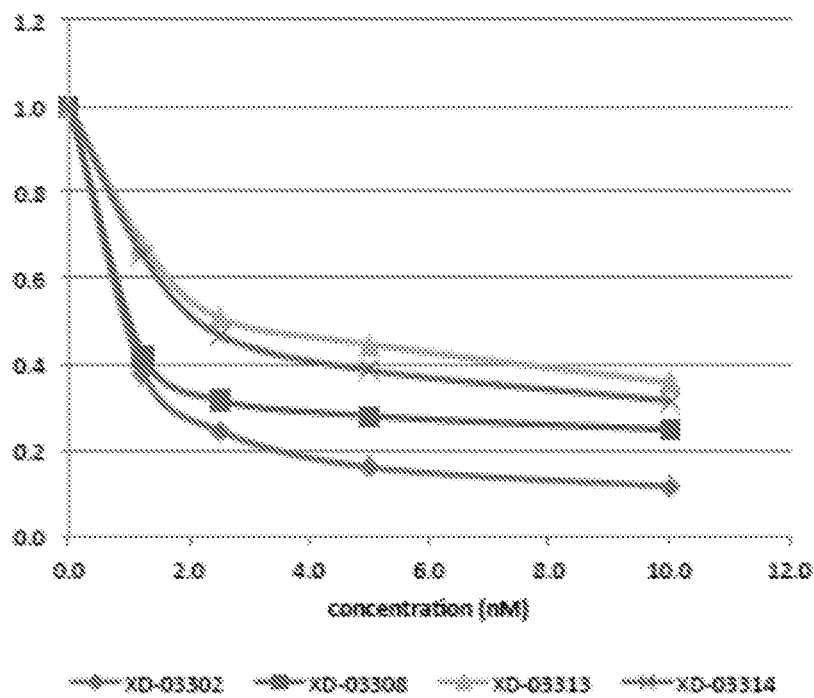
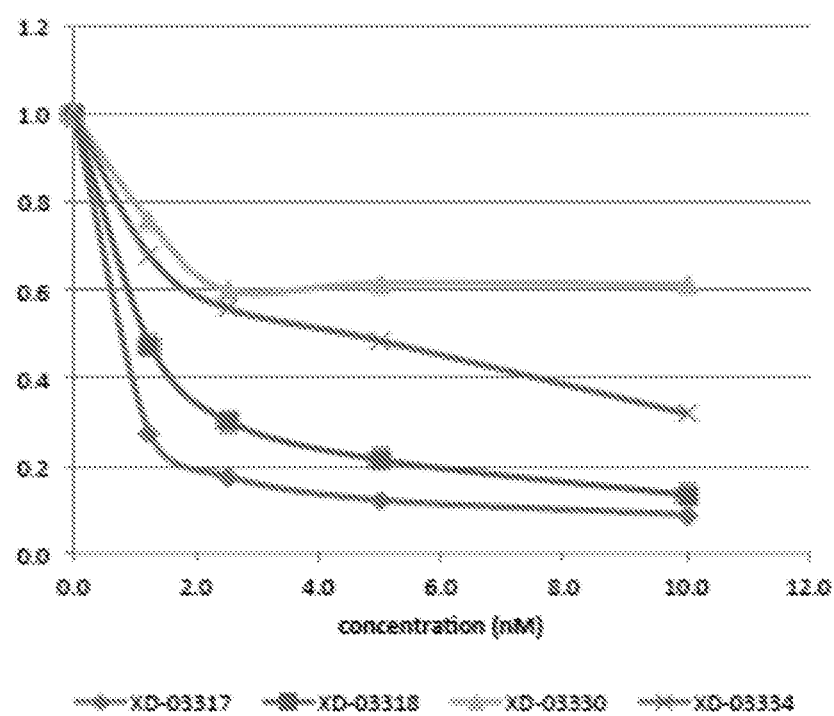

C/EBPα SHORT ACTIVATING RNA COMPOSITIONS AND METHODS OF USE

CROSS-REFERENCE TO RELATED APPLICATIONS

This application is a continuation application of U.S. Non-provisional application Ser. No. 15/038,332, filed May 20, 2016, now issued as U.S. Pat. No. 10,202,601, which claims priority to U.S. Prov. Application No. 61/907,732, filed Nov. 22, 2013, the contents of each of which are incorporated herein by reference in their entirety.

SEQUENCE LISTING

The instant application contains a Sequence Listing which has been submitted electronically in ASCII format and is hereby incorporated by reference in its entirety. Said ASCII copy, created on Dec. 19, 2018 is named 2058-1008US-CON_SEQLST.txt and is 801,472 bytes in size.

FIELD OF THE INVENTION

The invention relates to polynucleotide, specifically saRNA, compositions for the modulating C/EBPα and C/EBPα pathways and to the methods of using the compositions in therapeutic applications such as treating metabolic disorders, hyperproliferative diseases, and regulating stem cell lineage.

BACKGROUND OF THE INVENTION

CCAAT/enhancer-binding protein α (C/EBPα, C/EBP alpha or C/EBPA) is a leucine zipper protein that is conserved across humans and rats. This nuclear transcription factor is enriched in hepatocytes, myelomonocytes, adipocytes, as well as other types of mammary epithelial cells [Lekstrom-Himes et al., *J. Bio. Chem*, vol. 273, 28545-28548 (1998)]. It is composed of two transactivation domains in the N-terminal part, and a leucine zipper region mediating dimerization with other C/EBP family members and a DNA-binding domain in the C-terminal part. The binding sites for the family of C/EBP transcription factors are present in the promoter regions of numerous genes that are involved in the maintenance of normal hepatocyte function and response to injury. C/EBPα has a pleiotropic effect on the transcription of several liver-specific genes implicated in the immune and inflammatory responses, development, cell proliferation, anti-apoptosis, and several metabolic pathways [Darlington et al., *Current Opinion of Genetic Development*, vol. 5(5), 565-570 (1995)]. It is essential for maintaining the differentiated state of hepatocytes. It activates albumin transcription and coordinates the expression of genes encoding multiple ornithine cycle enzymes involved in urea production, therefore playing an important role in normal liver function.

In the adult liver, C/EBPα is defined as functioning in terminally differentiated hepatocytes whilst rapidly proliferating hepatoma cells express only a fraction of C/EBPα [Umek et al., *Science*, vol. 251, 288-292 (1991)]. C/EBPα is known to up-regulate p21, a strong inhibitor of cell proliferation through the up-regulation of retinoblastoma and inhibition of Cdk2 and Cdk4 [Timchenko et al., *Genes & Development*, vol. 10, 804-815 (1996); Wang et al., *Molecular Cell*, vol. 8, 817-828 (2001)]. In hepatocellular carcinoma (HCC), C/EBPα functions as a tumor suppressor with anti-proliferative properties [Iakova et al., *Seminars in Cancer Biology*, vol. 21(1), 28-34 (2011)].

Different approaches are carried out to study C/EBPα mRNA or protein modulation. It is known that C/EBPα protein is regulated by post-translational phosphorylation and sumoylation. For example, FLT3 tyrosine kinase inhibitors and extra-cellular signal-regulated kinases 1 and/or 2 (ERK1/2) block serine-21 phosphorylation of C/EBPα, which increases the granulocytic differentiation potential of the C/EBPα protein [Radomska et al., *Journal of Experimental Medicine*, vol. 203(2), 371-381 (2006) and Ross et al., *Molecular and Cellular Biology*, vol. 24(2), 675-686 (2004)]. In addition, C/EBPα translation can be efficiently induced by 2-cyano-3,12-dioxoolean-1,9-dien-28-oic acid (CDDO), which alters the ratio of the C/EBPα protein isoforms in favor of the full-length p42 form over p30 form thereby inducing granulocytic differentiation [Koschmieder et al., *Blood*, vol. 110(10), 3695-3705 (2007)].

The C/EBPα gene is an intronless gene located on chromosome 19q13.1. Most eukaryotic cells use RNA-complementarity as a mechanism for regulating gene expression. One example is the RNA interference (RNAi) pathway which uses double stranded short interfering RNAs to knockdown gene expression via the RNA-induced silencing complex (RISC). It is now established that short duplex RNA oligonucleotides also have the ability to target the promoter regions of genes and mediate transcriptional activation of these genes and they have been referred to as RNA activation (RNAa), antigene RNA (agRNA) or short activating RNA (saRNA) [Li et al., *PNAS*, vol. 103, 17337-17342 (2006)]. saRNA induced activation of genes is conserved in other mammalian species including mouse, rat, and non-human primates and is fast becoming a popular method for studying the effects of endogenous up-regulation of genes.

Thus, there is a need for targeted modulation of C/EBPα for therapeutic purposes with saRNA.

SUMMARY OF THE INVENTION

The present invention provides compositions, methods and kits for the design, preparation, manufacture, formulation and/or use of short activating RNA (saRNA) molecules that modulate C/EBPα gene expression and/or function for therapeutic purposes, including diagnosing and prognosis.

One aspect of the invention provides a pharmaceutical composition comprising a saRNA that targets a C/EBPα transcript and at least one pharmaceutically acceptable carrier.

Another aspect of the invention provides a method of modulating the metabolic pathway of a subject comprising administering a saRNA that targets a C/EBPα transcript to said subject.

Another aspect of the invention provides a method of inhibiting the proliferation of hyperproliferative cells comprising contacting the cells with a saRNA that targets a C/EBPα transcript.

Another aspect of the invention provides a method of treating or preventing hyperproliferative disorders comprising administering a saRNA that targets a C/EBPα transcript to a subject with said hyperproliferative disorder.

Another aspect of the invention provides a method of regulating epithelial-mesenchymal transition of a cell comprising contact the cell with a saRNA that targets a C/EBPα transcript.

Yet another aspect of the invention provides a method of regulating stem cell differentiation and pluripotency comprising contact said stem cell with a saRNA that targets a C/EBPα transcript.

The details of various embodiments of the invention are set forth in the description below. Other features, objects, and advantages of the invention will be apparent from the description and the drawings, and from the claims.

BRIEF DESCRIPTION OF THE DRAWINGS

The foregoing and other objects, features and advantages will be apparent from the following description of particular embodiments of the invention, as illustrated in the accompanying drawings in which like reference characters refer to the same parts throughout the different views. The drawings are not necessarily to scale, emphasis instead being placed upon illustrating the principles of various embodiments of the invention.

FIG. 3A to 3G are a series of histograms illustrating the effects of saRNA of the present invention. FIG. 3A shows transfection of C/EBPα-saRNA in HepG2 cells positively regulates expression of C/EBPα gene; FIG. 3B shows Transfection of C/EBPα-saRNA in HepG2 cells positively regulates expression of albumin gene. FIG. 3C is a dose escalation of C/EBPα-saRNA demonstrates a dose-dependent effect over 96 hrs on C/EBPα gene expression. FIG. 3D is a dose escalation of C/EBPα-saRNA demonstrates a dose-dependent effect over 96 hrs on albumin gene expression. Panels E-G (FIG. 3E-FIG. 3G) show the D site of the albumin promoter (albumin D-box) binding protein (DBP), and albumin (ALB) all have one or more C/EBPα binding sites. The panels show the genomic region containing (E) C/EBPα, (F) DBP and (G) Albumin (ALB) 2000 nucleotides upstream and downstream of each gene. Shown are the chromosomal coordinates ("Scale" and chromosome identifier), C/EBPα binding sites ("CEBPA"; black boxes), occurrences of the C/EBPα binding motif ("GCAAT motif"; black vertical lines), and RefSeq genes within the genomic regions.

FIG. 4C: An enzyme linked immunosorbent assay (ELISA) specific for human albumin detected a significant increase of albumin secretion following transfection of 20 nM C/EBPα-saRNA. FIG. 4D: Expression of the gene encoding ornithine cycle enzyme Ornithine transcarbamylase (OTC) increased in C/EBPα-saRNA transfected cells suggesting an improved ability of urea production. FIG. 4E: Decreased expression of the gene encoding alphafetoprotein (AFP) in C/EBPα-saRNA transfected cells suggested improved regulation of cell differentiation. FIG. 4F: C/EBPα-saRNA caused a marked down-regulation of HepG2 cell proliferation at different concentrations.

FIG. 5A-FIG. 5F: Intravenous injection of C/EBPα-saRNA in male Wistar rats with chronic liver cirrhosis and spontaneous hepatocellular carcinoma. C/EBPα-saRNA-dendrimer was tested for nuclease sensitivity in rat serum for the indicated times. A Significant decrease of saRNA in the blood was observed between 24 and 48 hours. Rats were then treated with C/EBPα-saRNA-dendrimer for one week with repeat dose every 48 hours. Albumin, bilirubin, aspartate transaminase (AST), alanine transaminase (ALT) levels were measured. Increase in circulating levels of albumin suggests amelioration from liver injury when compared to control.

FIG. 6A: Liver tumor volumes were visibly reduced in C/EBPα-saRNA-dendrimer injected rats when compared to control. FIG. 6B: Tumor burden was assessed by the volume of all tumor nodules with a diameter in excess of 3 mm. C/EBPα-saRNA injected rats had significantly reduced tumor burden after two weeks of treatment. FIG. 6C: 2 μm liver sections from control, scramble-saRNA injected and C/EBPα-saRNA-dendrimer injected rats were immunostained for expression of placenta-form glutathione-S-transferase (GST-p).

FIG. 7A-FIG. 7D: Total RNA extracts from 7 control rats v.s. 7 C/EBPα-saRNA-dendrimer injected rats were analyzed for (FIG. 7A) albumin gene expression, (FIG. 7B) C/EBPα gene expression, (FIG. 7C) hepatocyte nuclear factor (HNF) 4a gene expression, and (FIG. 7D) HNF1α gene expression, An increase in these factors confirmed up-regulation of the transcription factors required to promote expression of albumin. Decreased mRNA levels encoding HGF. FIG. 7E-FIG. 7G: Total RNA extracts from 7 control rats vs 7 C/EBPα-saRNA-dendrimer injected rats were analyzed for (FIG. 7E) hepatocyte growth factor (HGF) gene expression, (FIG. 7F) hydroxyphenylpyruvic acid dioxygenase (HPD1) gene expression, and (FIG. 7G) plasminogen gene expression. Decreased mRNA levels encoding HGF indicates positive regulation of cell proliferation. Increased levels of HPD1 and plasminogen indicate improved function of hepatocytes.

FIG. 8A-8C: Transfection of C/EBPα-saRNA reduced relative expression of STAT3 (A), cMyc (B) and IL6R (C) in HepG2 cells.

FIG. 9A-FIG. 9C: A methylation assay of the CpG islands at the promoter regions of STAT3 (FIG. 9A), MYC (FIG. 9B) and IL6R (FIG. 9C) demonstrated hypermethylation when compared to control. FIG. 9D: A Western blot analysis showed decreased phosphorylation of STAT3 at residues 705 and 727 and down-regulation of IL6R in cells transfected with C/EBPα-saRNA.

FIG. 10: C/EBPα expression in huh7 liver cell line was tested with control, C/EBPα-saRNA alone, different dendrimers, and C/EBPα-saRNA-dendrimer complexes with different saRNA:dendrimer complex ratios. Samples were often in duplicate.

FIG. 15A-15F: Proliferation study of the saRNA of the invention. FIG. 15A-FIG. 15F: Cell proliferation of human HCC (HepG2) (FIG. 15A), rat liver cancer (FIG. 15B), human pancreatic epitheloid carcinoma (FIG. 15C), human breast adenocarcinoma (MCF7) (FIG. 15D), human metastatic prostate cancer (DU145) (FIG. 15E), rat insulinoma (MIN6) (FIG. 15F) cells after C/EBPα-saRNA transfection.

FIG. 16: Cell proliferation of MIN6, fibroblast, MCF7, HepG2, rat liver, Panc1 and Du145 cells after C/EBPα-saRNA transfection.

FIG. 30A-FIG. 30B: C/EBPα-saRNA altered circulating levels of cholesterol (A) and LDL (B).

FIG. 18A-FIG. 18D: CEBPα, CD36, LPL and LXR expression in rats treated with C/EBPα-saRNA carried by dendrimers and controls.

FIG. 20A-FIG. 20O: CEBPα, SREBF-1, CD36, ACACB, APOC3, MTP, PPARγ-CoA1α, LDLR, PPARγ-CoA1β, PPARγ, ACACA, MLXIPL, PPARγ, FASN, and DGAT2 expression in liver cells of rats treated with C/EBPα-saRNA carried by dendrimers and controls.

FIG. 21A-FIG. 21M: SREBP, CD36, LDLR, PPARGC1A, APOC, ACACB, PERC, ACACA, MLXP1, MTOR, PPARA, FASN, DGAT expression in BAT cells transfected with C/EBPα-saRNA.

FIG. 22A-FIG. 22M: SREBP, CD36, LDLR, PPARGC1A, MTP, APOC, ACACB, PERC, ACACA, MLX1PL, MTOR, FASN, DGAT expression in WAT cells transfected with C/EBPα-saRNA.

FIG. 24: C/EBPα, C/EBPβ, and NANOG relative expression levels following C/EBPα-saRNA transfection.

FIG. 25: C/EBPα expression levels in U87-fLuc cells 4 days after transfection with C/EBPα-saRNA (CAW1) or transduction with C/EBPα-saRNA in a miRNA design cloned into clinical retroviral replicating vector (miCAW1). Scrambled siRNA (con) and retrovirus vector delivering a small inhibitory hairpin against firefly Luciferase (mifLuc) used as negative controls.

FIG. 26: C/EBPα-AW1 miRNA insert sequence (SEQ ID NO: 383) and common miR-30 context (SEQ ID NO: 384).

FIG. 28A-FIG. 28C show CEBPA, ALB, p21 mRNA expression levels in DU145 cells with 50 nM C/EBPα-saRNA transfection. FIG. 28D-FIG. 28F show CEBPA, ALB, p21 mRNA expression levels in DU145 cells with 10 nM C/EBPα-saRNA transfection.

FIG. 29A-FIG. 29B show CEBPA and ecCEBPA mRNA expression levels in DU145 cells with 50 nM C/EBPα-saRNA transfection. FIG. 29C-FIG. 29D show CEBPA and ecCEBPA mRNA expression levels in DU145 cells with 10 nM C/EBPα-saRNA transfection. FIG. 29E shows ESTS of CEBPA mRNA, AW665812 levels in DU145 cells with 50 nM C/EBPα-saRNA transfection.

FIG. 31A shows reduced proliferation for CEBPA-saRNA treated HepG2 cells. FIG. 31B-FIG. 31G show CEBPA, p21 and albumin mRNA levels in HepG2 cells at different time points after C/EBPα-saRNA transfection.

FIG. 32A shows reduced proliferation for CEBPA-saRNA treated DU145 cells. FIG. 32B-FIG. 32G show CEBPA, p21 and albumin mRNA levels in DU145 cells at different time points after C/EBPα-saRNA transfection.

FIG. 33A shows reduced proliferation for CEBPA-saRNA treated AML cells. FIG. 33B-FIG. 33G show CEBPA, p21 and albumin mRNA levels in AML cells at different time points after C/EBPα-saRNA transfection.

FIG. 34A-FIG. 34F show CEBPA, ALB and p21 mRNA levels in DU145 and HepG2 cells after formulated NOV340-CEBPA-saRNA transfection.

FIG. 35A shows a flow chart of in vivo studies of formulated CEBPA-saRNA conducted with DEN rats. FIG. 35B shows tumor burden at day 12. FIG. 35C shows serum bilirubin levels at day 12. FIG. 35D shows ALT liver enzyme levels at day 12. FIG. 35E shows serum albumin levels at day 12. FIG. 35F shows cholesterol levels at day 12.

FIG. 36A and FIG. 36B show western blot results of in HepG2 cells transfected with biotin-labeled CEBPA-saRNA.

FIG. 38A-FIG. 38C show CEBPA, albumin and p21 mRNA levels of HepG2 cells after CEBPA-saRNA transfection. FIG. 38D-FIG. 38E show CEBPA and p21 mRNA levels of DU145 cells after CEBPA-saRNA transfection.

FIG. 39A-39G: Expression study. FIG. 39A-FIG. 39D shows CEBPA, albumin, p21 and GAPDH mRNA levels in HepG2 cells transfected with different concentrations of CEBPA-saRNA. FIG. 39E-FIG. 39G show CEBPA, p21 and GAPDH mRNA levels in DU145 cells transfected with different concentrations of CEBPA-saRNA.

DETAILED DESCRIPTION

Figure 1:
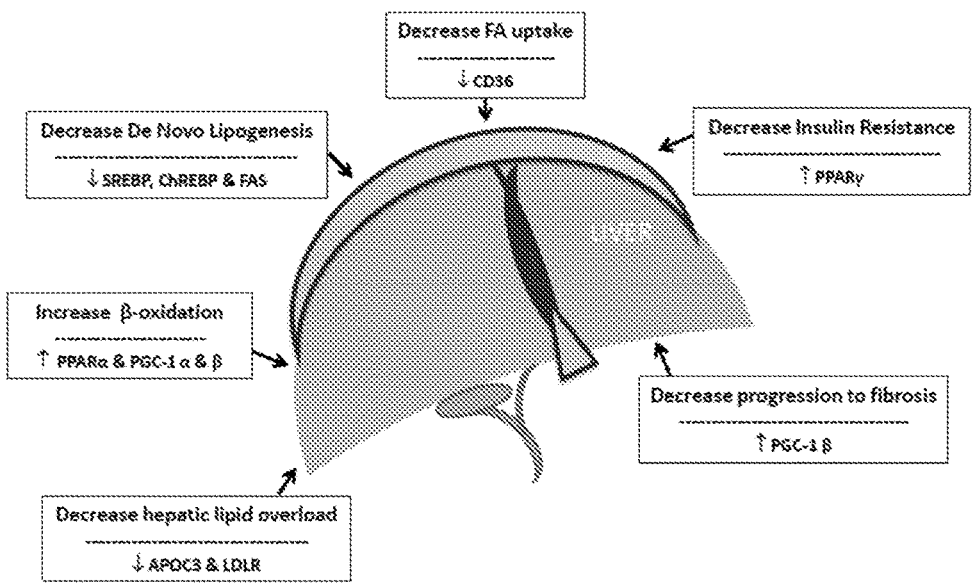
FIG. 1 shows the primary effects of C/EBPα on the liver.

The present invention provides compositions, methods and kits for modulating C/EBPα gene expression and/or function for therapeutic purposes. These compositions, methods and kits comprise nucleic acid constructs that target a C/EBPα transcript.

C/EBPα protein is known as a critical regulator of metabolic processes and cell proliferation. Modulating C/EBPα gene has great potentials for therapeutic purposes. The present invention addresses this need by providing nucleic acid constructs targeting a C/EBPα transcript, wherein the nucleic acid constructs may include single or double stranded DNA or RNA with or without modifications.

The terms "target" or "targeting" in the context mean having an effect on a C/EBPα transcript. The effect may be direct or indirect. Direct effect may be caused by complete or partial hybridization with the C/EBPα transcript. Indirect effect may be upstream or downstream.

The terms "C/EBPα transcript", "C/EBPα target transcript" or "target transcript" in the context may be located on any strand of the C/EBPα gene, an antisense RNA of the C/EBPα gene, C/EBPα mRNA encoding C/EBPα protein, or a non-coding RNA regulating C/EBPα gene expression. One example of a non-coding RNA regulating C/EBPα gene expression is a long non-coding RNA (lncRNA). The antisense RNA of the C/EBPα gene is called a target antisense RNA transcript herein after.

In one embodiment, nucleic acid constructs targeting a C/EBPα transcript modulates C/EBPα gene expression and/or function.

The term "modulate" in the context may include upregulating or downregulating C/EBPα gene expression and/or function.

The term "gene expression" in the context may include the transcription step of generating C/EBPα mRNA from C/EBPα gene or the translation step generating C/EBPα protein from C/EBPα mRNA. An increase of C/EBPα mRNA and an increase of C/EBPα protein both indicate an increase or a positive effect of C/EBPα gene expression.

I. Composition of the Invention

One aspect of the present invention provides pharmaceutical compositions comprising nucleic acid constructs that target a C/EBPα transcript, and at least one pharmaceutically acceptable carrier. One example of such nucleic acid constructs is a small activating RNA (saRNA), referred herein after as "C/EBPα-saRNA", or "saRNA of the present invention", used interchangeably in this application.

The terms "small activating RNA" or "saRNA" in the context mean a single stranded or double stranded RNA typically with less than 50 nucleotides that upregulates or has a positive effect on the gene expression of a specific gene. Said gene is called the target gene of said saRNA. For example, C/EBPα gene is the target gene of C/EBPα-saRNA of the present invention.

saRNA Design

C/EBPα-saRNA targets a C/EBPα transcript. In one embodiment, it is designed to be complementary to a target antisense RNA transcript of C/EBPα gene, and it may exert its effect on C/EBPα gene expression and/or function by down-regulating the target antisense RNA transcript.

The term "complementary to" in the context means being able to hybridize with the target antisense RNA transcript under stringent conditions.

The term "sense" when used to describe a nucleic acid sequence in the context of the present invention means that the sequence has identity to a sequence on the coding strand of a gene. The term "antisense" when used to describe a nucleic acid sequence in the context of the present invention means that the sequence is complementary to a sequence on the coding strand of a gene.

The target antisense RNA transcript may be transcribed from a locus up to 100, 80, 60, 40, 20 or 10 kb upstream of C/EBPα gene's transcription start site (TSS), or from a locus up to 100, 80, 60, 40, 20 or 10 kb downstream of C/EBPα gene's transcription stop site. In one embodiment, the target antisense RNA transcript is transcribed from a locus up to 1 kb upstream of C/EBPα gene's transcription start site or from a locus up to 1 kb downstream of C/EBPα gene's transcription stop site. In another embodiment, the target antisense RNA transcript is transcribed from a locus up to 500, 250 or 100 nucleotides upstream of C/EBPα gene's transcription start site or from a locus up to 500, 250 or 100 nucleotides downstream of C/EBPα gene's transcription stop site. Preferably the locus is no more than 500 nucleotides upstream or downstream from C/EBPα gene's transcription start site.

The term "is transcribed from [a particular locus]" in the context of the target antisense RNA transcript of the invention means "the transcription start site of the target RNA transcript is found [at the particular locus]". In one embodiment, both of the transcription start site and the transcription stop site of the target antisense RNA transcript are, separately, located either up to 100 kb upstream of C/EBPα gene's transcription start site or up to 100 kb downstream of C/EBPα gene's transcription stop site.

The target antisense RNA transcript is complementary to the coding strand of the genomic sequence of C/EBPα gene, and any reference herein to "genomic sequence" is shorthand for "coding strand of the genomic sequence".

The "coding strand" of a gene is the strand which contains the coding sequence for the gene's mRNA. The "template strand" of a gene is the strand which does not contain the coding sequence for the gene's mRNA.

Thus, the target antisense RNA transcript may comprise a sequence which is complementary to a genomic sequence located between 100, 80, 60, 40, 20 or 10 kb upstream of C/EBPα gene's transcription start site and 100, 80, 60, 40, 20 or 10 kb downstream of C/EBPα gene's transcription stop site. In one embodiment, the target antisense RNA transcript comprises a sequence which is complementary to a genomic sequence located between 1 kb upstream of C/EBPα gene's transcription start site and 1 kb downstream of C/EBPα gene's transcription stop site. In another embodiment, the target antisense RNA transcript comprises a sequence which is complementary to a genomic sequence located between 500, 250 or 100 nucleotides upstream of C/EBPα gene's transcription start site and ending 500, 250 or 100 nucleotides downstream of C/EBPα gene's transcription stop site. The target antisense RNA transcript may comprise a sequence which is complementary to a genomic sequence which includes the coding region of C/EBPα gene. Most preferably, the target antisense RNA transcript comprises a sequence which is complementary to a genomic sequence in C/EBPα gene's promoter region. Thus, the target antisense RNA transcript preferably comprises a sequence which is complementary to the promoter region of C/EBPα gene.

Genes may possess a plurality of promoter regions, in which case the target antisense RNA transcript may overlap with one, two or more of the promoter regions. Online database of annotated gene loci may be used to identify the promoter regions of genes.

The region of overlap, i.e., complementary region, between the target antisense RNA transcript and the promoter region of C/EBPα gene may be partial and may be as short as a single nucleotide in length, although it is preferably at least 15 nucleotides in length, more preferably at least 25 nucleotides in length, more preferably at least 50 nucleotides in length, more preferably at least 75 nucleotides in length, most preferably at least 100 nucleotides in length. Each of the following specific arrangements is intended to fall within the scope of the term "overlap":

a) The target antisense RNA transcript and C/EBPα gene's promoter region are identical in length and they overlap (i.e. they are complementary over their entire lengths).

b) The target antisense RNA transcript is shorter than C/EBPα gene's promoter region and overlaps over its entire length with C/EBPα gene's promoter region (i.e. it is complementary over its entire length to a sequence within C/EBPα gene's promoter region).

c) The target antisense RNA transcript is longer than C/EBPα gene's promoter region and C/EBPα gene's promoter region is overlapped fully by it (i.e. C/EBPα gene's promoter region is complementary over its entire length to a sequence within the target antisense RNA transcript).

d) The target antisense RNA transcript and C/EBPα gene's promoter region are of the same or different lengths and the region of overlap is shorter than both the length of the target antisense RNA transcript and the length of C/EBPα gene's promoter region.

The above definition of "overlap" applies mutatis mutandis to the description of other overlapping sequences throughout the description. Clearly, if a target antisense RNA transcript is described as overlapping with a region of C/EBPα gene other than the promoter region then the sequence of the target antisense RNA transcript is complementary to a sequence within that region rather than within the promoter region of C/EBPα gene.

In one embodiment, the target antisense RNA transcript comprises a sequence which is complementary to a genomic sequence which comprises C/EBPα gene's transcription start site. In other words, the target antisense RNA transcript comprises a sequence which overlaps with C/EBPα gene's transcription start site.

In one embodiment, the target antisense RNA transcript is at least 1 kb, preferably at least 2, 3, 4, 5, 6, 7, 8, 9 or 10, e.g., 20, 25, 30, 35 or 40 kb long.

In one embodiment, the target antisense RNA transcript comprises a sequence which is at least 75%, preferably at least 85%, more preferably at least 90%, still more preferably at least 95% complementary along its full length to a sequence on the coding strand of C/EBPα gene.

The present invention provides saRNA targeting the target antisense RNA transcript and may effectively and specifically down-regulate such target antisense RNA transcripts. This can be achieved by saRNA having a high degree of complementarity to a sequence within the target antisense RNA transcript. The saRNA will have no more than 5, preferably no more than 4 or 3, more preferably no more than 2, still more preferably no more than 1, most preferably no mismatches with the sequence within the target antisense RNA transcript.

In one embodiment, the saRNA of the present invention comprises a sequence of at least 13 nucleotides which has at least 95, 98, 99 or 100% complementarity to a region of the target antisense RNA transcript. Preferably, said sequence which has at least 95, 98, 99 or 100% complementarity to a region of the target antisense RNA transcript is at least 15, 16, 17, 18 or 19 nucleotides in length, preferably 18-22 or 19 to 21, most preferably exactly 19. The saRNA of the present invention may also comprise a 3' tail, which may be UU or UUU.

In one embodiment, the saRNA of the present invention may have two strands that form a duplex, one strand being a guide strand. It may have siRNA-like complementarity to a region of the target transcript; that is, 100% complementarity between nucleotides 2-6 from the 5' end of the guide strand in the saRNA duplex and a region of the target antisense RNA transcript. Other nucleotides of the saRNA may, in addition, have at least 70, 80, 90, 95, 99 or 100% complementarity to a region of the target antisense RNA transcript. For example, nucleotides 7 (counted from the 5' end) until the 3' end of the saRNA may have least 70, 80, 90, 95, 99 or 100% complementarity to a region of the target antisense RNA transcript.

The terms "small interfering RNA" or "siRNA" in the context mean a double-stranded RNA typically 20-25 nucleotides long involved in the RNA interference (RNAi) pathway and interfering with or inhibiting the expression of a specific gene. Said gene is the target gene of said siRNA. For example, siRNA that interferes the expression of C/EBPβ gene is called "C/EBPβ-siRNA" and C/EBPβ gene is the target gene. siRNA that interferes with the expression of C/EBPα is called "C/EBPα-siRNA" and C/EBPα is the target gene. siRNA is usually about 21 nucleotides long, with 3' overhangs (2 nucleotides) at each end of the two strands.

siRNA inhibits target gene expression by binding to and promoting the cleavage of one or more RNA transcripts of said gene at specific sequences. Typically in RNAi the RNA transcripts are mRNA, so cleavage of mRNA results in the down-regulation of gene expression. In the present invention, not willing to be bound with any theory, one of the possible mechanisms is that C/EBPα-saRNA may modulate C/EBPα gene expression by cleavage of the target antisense RNA transcript.

The skilled person will appreciate that it is convenient to define the saRNA of the present invention by reference to the target antisense RNA transcript, regardless of the mechanism by which the saRNA modulates C/EBPα gene expression. However, the saRNA of the present invention may alternatively be defined by reference to C/EBPα gene. The target antisense RNA transcript is complementary to a genomic region on the coding strand of C/EBPα gene, and the saRNA of the present invention is in turn complementary to a region of the target antisense RNA transcript, so the saRNA of the present invention may be defined as having sequence identity to a region on the coding strand of C/EBPα gene. All of the features discussed herein with respect to the definition of the saRNA of the present invention by reference to the target antisense RNA transcript apply mutatis mutandis to the definition of the saRNA of the present invention by reference to C/EBPα gene so any discussion of complementarity to the target antisense RNA transcript should be understood to include identity to the genomic sequence of C/EBPα gene. Thus, the saRNA of the present invention preferably has a high percent identity, e.g. at least 75, 80, 85, 90, 95, 98 or 99, preferably 100% identity, to a genomic sequence on C/EBPα gene. It is preferable that the genomic sequence is up to 500 nucleotides upstream or downstream of C/EBPα gene's transcription start site. Most preferably, it is within C/EBPα gene's promoter region. Thus, the saRNA preferably has sequence identity to a sequence that is within the promoter region of C/EBPα gene.

The saRNA of the present invention may be single or, preferably, double stranded. Double stranded molecules comprise a first strand and a second strand. If double stranded, preferably each strand of the duplex is at least 14, more preferably at least 18, e.g. 19, 20, 21 or 22 nucleotides in length. Preferably the duplex is hybridized over a length of at least 12, more preferably at least 15, more preferably 17, still more preferably at least 19 nucleotides. Each strand may be exactly 19 nucleotides in length. Preferably, the length of the saRNA is less than 30 nucleotides since oligonucleotide duplex exceeding this length may have an increased risk of inducing the interferon response. The strands forming the saRNA duplex may be of equal or unequal lengths.

The saRNA of the present invention may include a short 3' or 5' sequence which is not complementary to the target antisense RNA transcript. In one embodiment, such a sequence is 3'. Said sequence may be 1-5 nucleotides in length, preferably 2 or 3. Said sequence preferably comprises uracil, so preferably it is a 3' stretch of 2 or 3 uracils. This non-complementary sequence may be referred to as "tail". If a 3' tail is present, the strand may be longer, e.g., 19 nucleotides plus a 3' tail, which is preferably UU or UUU. The saRNA of the present invention may further comprise Dicer or Drosha substrate sequences.

The saRNA of the present invention may contain a flanking sequence. The flanking sequence may be inserted in the 3' end or 5' end of the saRNA of the present invention. In one embodiment, the flanking sequence is the sequence of a miRNA, rendering the saRNA to have miRNA configuration and may be processed with Drosha and Dicer. In a non-limiting example, the saRNA of the present invention has two strands and is cloned into a miR-30 backbone flanking sequence.

The saRNA of the present invention may comprise a restriction enzyme substrate or recognition sequence. The restriction enzyme recognition sequence may be at the 3' end or 5' end of the saRNA of the present invention. Non-limiting examples of restriction enzymes include NotI and AscI.

In one embodiment, the saRNA of the present invention consist of the two strands stably base-paired together with a number of unpaired nucleotides at the 3' end of each strand forming 3' overhangs. The number of unpaired nucleotides forming the 3' overhang of each strand is preferably in the range of 1 to 5 nucleotides, more preferably 1 to 3 nucleotides and most preferably 2 nucleotides. The 3' overhang may be formed on the 3' tail mentioned above, so the 3' tail may be the 3' overhang.

Thus, the saRNA of the present invention preferably consists of (i) a sequence having at least 95% complementarity to a region of the target antisense RNA transcript; and (ii) a 3' tail of 1-5 nucleotides, which preferably comprises uracil residues. The saRNA of the present invention preferably has complementarity to a region of the target antisense RNA transcript over its whole length, except for the 3' tail, if present. As mentioned above, instead of "complementary to the target antisense RNA transcript" the saRNA of the present invention may also be defined as having "identity" to the coding strand of the C/EBPα gene.

The design of saRNA is also disclosed in copending PCT Application No. PCT/GB2012/051422, copending US Pat. Pub. No. 2013/0164846 (saRNA algorithm), U.S. Pat. Nos. 8,324,181 and 7,709,566 to Corey et al., US Pat. Pub. No. 2010/0210707 to Li et al., and Voutila et al., *Mol Ther Nucleic Acids*, vol. 1, e35 (2012), the contents of each of which are incorporated herein by reference in their entirety.

As described herein, the sequence for C/EBPα gene is used to design C/EBPα-saRNA. The sequence of a target C/EBPα transcript may be determined from the sequence of C/EBPα gene for designing C/EBPα-saRNA. However, the existence of such a C/EBPα transcript does not need to be determined. Preferred sequences of suitable C/EBPα-saRNA of the present invention are provided in Table 1. Thus, provided is C/EBPα-saRNA having a first strand comprising a sequence selected from SEQ ID Nos: 2, 4, 6, 8, 10, and 12. Optionally, the C/EBPα-saRNA may comprise a 3' tail at the 3' end of these sequences.

Single stranded C/EBPα-saRNA only consists of a first strand, whereas double stranded C/EBPα-saRNA also has a second strand. The double stranded C/EBPα-saRNA may thus have a second strand comprising a sequence selected from SEQ ID Nos: 1, 3, 5, 7, 9, and 11.

A double stranded C/EBPα-saRNA having a first strand of SEQ ID No: 2 and a second strand of SEQ ID No: 1 is preferred.

TABLE 1 saRNA sequences

| ID | | Target (Sense) | SEQ ID NO | Anti-sense (Guide) | SEQ ID NO |
|---|---|---|---|---|---|
| Human C/EBPα | AW1 | CGGUCAUUGUCACUGGUCA | 1 | UGACCAGUGACAAUGACCG | 2 |
| | AW2 | AGCUGAAAGGAUUCAUCCU | 3 | AGGAUGAAUCCUUCCAGCU | 4 |
| | NR1 | ACAUAGUCCCAGUGAUUAA | 5 | UUAAUCACUGGGACUAUGU | 6 |
| | NR2 | GAAUAAGACUUUGUCCAAU | 7 | AUUGGACAAAGUCUUAUUC | 8 |
| | PR1 | GCGCGGAUUCUCUUUCAAA | 9 | UUUGAAAGAGAAUCCGCGC | 10 |
| | PR2 | CCAGGAACUCGUCGUUGAA | 11 | UUCAACGACGAGUUCCUGG | 12 |

Bifunction or dual-functional oligonucleotides are also designed to up-regulate C/EBPα gene expression and down-regulate C/EBPβ gene expression. One strand of the dual-functional oligonucleotide activates C/EBPα gene expression and the other inhibits C/EBPβ gene expression. Preferred dual-functional oligonucleotide sequences are shown in Table 2A. Each strand might further comprise a Dicer substrate sequence as shown in Table 2B.

TABLE 2A

Bifunction oligonucleotide sequences

| ID | 19 mer 1 (Target C/EBPβ (NM_005194)) | 19 mer 2 (Target C/EBPα-AS (NM_004364)) |
|---|---|---|
| sa-CEBPA_si-CEBPB-1 | AGAAGUUGGCCACUUCCAU (SEQ ID NO. 13) | AUGGAGUCGGCCGACUUCU (SEQ ID NO. 14) |
| sa-CEBPA_si-CEBPB-2 | AAGAGGUCGGAGAGGAAGU (SEQ ID NO. 15) | AGUUCCUGGCCGACCUGUU (SEQ ID NO. 16) |
| sa-CEBPA_si-CEBPB-3 | UUGUACUCGUCGCUGUGCU (SEQ ID NO. 17) | AGAACAGCAACGAGUACCG (SEQ ID NO. 18) |
| sa-CEBPA_si-CEBPB-4 | UACUCGUCGCUGUGCUUGU (SEQ ID NO. 19) | ACAAGAACAGCAACGAGUA (SEQ ID NO. 20) |

TABLE 2B

Dice substrate sequences of bifunction oligonucleotide sequences

| ID | DicerSubstrateStrand1 (RNAs in upper case; DNAs in underlined lower case) | DicerSubstrateStrand2 (RNAs in upper case; DNAs in underlined lower case) |
|---|---|---|
| sa-CEBPA_si-CEBPB-1 | AGAAGUUGGCCACUUCCAUGGGGga (SEQ ID NO. 21) | tcCCCCAUGGAGUCGGCCGACUUCUAC (SEQ ID NO. 22) |
| sa-CEBPA_si-CEBPB-2 | AAGAGGUCGGAGAGGAAGUCGUCgt (SEQ ID NO. 23) | acGACGAGUUCCUGGCCGACCUGUUCC (SEQ ID NO. 24) |
| sa-CEBPA_si-CEBPB-3 | UUGUACUCGUCGCUGUGCUUGUCca (SEQ ID NO. 25) | tgGACAAGAACAGCAACGAGUACCGGG (SEQ ID NO. 26) |
| sa-CEBPA_si-CEBPB-4 | UACUCGUCGCUGUGCUUGUCCACcg (SEQ ID NO. 27) | cgGUGGACAAGAACAGCAACGAGUACC (SEQ ID NO. 28) |

The saRNA of the present invention may be produced by any suitable method, for example synthetically or by expression in cells using standard molecular biology techniques which are well-known to a person of ordinary skill in the art. For example, the saRNA of the present invention may be chemically synthesized or recombinantly produced using methods known in the art.

Chemical Modifications of saRNA

Herein, in saRNA, the terms "modification" or, as appropriate, "modified" refer to structural and/or chemical modifications with respect to A, G, U or C ribonucleotides. Nucleotides in the saRNA molecules of the present invention may comprise non-standard nucleotides, such as non-naturally occurring nucleotides or chemically synthesized nucleotides or deoxynucleotides. The saRNA of the present invention may include any useful modification, such as to the sugar, the nucleobase, or the internucleoside linkage (e.g. to a linking phosphate/to a phosphodiester linkage/to the phosphodiester backbone). One or more atoms of a pyrimidine nucleobase may be replaced or substituted with optionally substituted amino, optionally substituted thiol, optionally substituted alkyl (e.g., methyl or ethyl), or halo (e.g., chloro or fluoro). In certain embodiments, modifications (e.g., one or more modifications) are present in each of the sugar and the internucleoside linkage. Modifications according to the present invention may be modifications of ribonucleic acids (RNAs) to deoxyribonucleic acids (DNAs), threose nucleic acids (TNAs), glycol nucleic acids (GNAs), peptide nucleic acids (PNAs), locked nucleic acids (LNAs) or hybrids thereof. In a non-limiting example, the 2'-OH of U is substituted with—OMe.

The saRNA of the present invention can include a combination of modifications to the sugar, the nucleobase, and/or the internucleoside linkage. These combinations can include any one or more modifications described herein or in International Application Publication WO2013/052523 filed Oct. 3, 2012, in particular Formulas (Ia)-(Ia-5), (Ib)-(If), (IIa)-(IIp), (IIb-1), (IIb-2), (IIc-1)-(IIc-2), (IIn-1), (IIn-2), (IVa)-(IV1), and (IXa)-(IXr)), the contents of which are incorporated herein by reference in their entirety.

The saRNA of the present invention may or may not be uniformly modified along the entire length of the molecule. For example, one or more or all types of nucleotide (e.g., purine or pyrimidine, or any one or more or all of A, G, U, C) may or may not be uniformly modified in the saRNA of the invention. In some embodiments, all nucleotides X in a saRNA of the invention are modified, wherein X may be any one of nucleotides A, G, U, C, or any one of the combinations A+G, A+U, A+C, G+U, G+C, U+C, A+G+U, A+G+C, G+U+C or A+G+C.

Different sugar modifications, nucleotide modifications, and/or internucleoside linkages (e.g., backbone structures) may exist at various positions in a saRNA. One of ordinary skill in the art will appreciate that the nucleotide analogs or other modification(s) may be located at any position(s) of a saRNA such that the function of saRNA is not substantially decreased. The saRNA of the present invention may contain from about 1% to about 100% modified nucleotides (either in relation to overall nucleotide content, or in relation to one or more types of nucleotide, i.e. any one or more of A, G, U or C) or any intervening percentage (e.g., from 1% to 20%, from 1% to 25%, from 1% to 50%, from 1% to 60%, from 1% to 70%, from 1% to 80%, from 1% to 90%, from 1% to 95%, from 10% to 20%, from 10% to 25%, from 10% to 50%, from 10% to 60%, from 10% to 70%, from 10% to 80%, from 10% to 90%, from 10% to 95%, from 10% to 100%, from 20% to 25%, from 20% to 50%, from 20% to 60%, from 20% to 70%, from 20% to 80%, from 20% to 90%, from 20% to 95%, from 20% to 100%, from 50% to 60%, from 50% to 70%, from 50% to 80%, from 50% to 90%, from 50% to 95%, from 50% to 100%, from 70% to 80%, from 70% to 90%, from 70% to 95%, from 70% to 100%, from 80% to 90%, from 80% to 95%, from 80% to 100%, from 90% to 95%, from 90% to 100%, and from 95% to 100%).

In some embodiments, the saRNA of the present invention may be modified to be a spherical nucleic acid (SNA) or a circular nucleic acid. The terminals of the saRNA of the present invention may be linked by chemical reagents or enzymes, producing spherical saRNA that has no free ends. Spherical saRNA is expected to be more stable than its linear counterpart and to be resistant to digestion with RNase R exonuclease. Spherical saRNA may further comprise other structural and/or chemical modifications with respect to A, G, U or C ribonucleotides.

In some embodiments, the saRNA of the present invention may comprise inverted abasic modifications. In some embodiments, the inverted abasic modification may be at 5' terminus.

saRNA Conjugates and Combinations

Conjugation may result in increased stability and/or half life and may be particularly useful in targeting the saRNA of the present invention to specific sites in the cell, tissue or organism. The saRNA of the present invention can be designed to be conjugated to other polynucleotides, dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases, proteins, e.g., glycoproteins, or peptides, e.g., molecules having a specific affinity for a co-ligand, or antibodies e.g., an antibody, that binds to a specified cell type such as a cancer cell, endothelial cell, or bone cell, hormones and hormone receptors, non-peptidic species, such as lipids, lectins, carbohydrates, vitamins, cofactors, or a drug. Suitable conjugates for nucleic acid molecules are disclosed in International Publication WO 2013/090648 filed Dec. 14, 2012, the contents of which are incorporated herein by reference in their entirety.

According to the present invention, C/EBPα-saRNA may be administered with, or further encode one or more of RNAi agents, small interfering RNAs (siRNAs), small hairpin RNAs (shRNAs), long non-coding RNAs (lncRNAs), enhancer RNAs, enhancer-derived RNAs or enhancer-driven RNAs (eRNAs), microRNAs (miRNAs), miRNA binding sites, antisense RNAs, ribozymes, catalytic DNA, tRNA, RNAs that induce triple helix formation, aptamers or vectors, and the like to achieve different functions. The one or more RNAi agents, small interfering RNAs (siRNAs), small hairpin RNAs (shRNAs), long non-coding RNAs (lncRNA), microRNAs (miRNAs), miRNA binding sites, antisense RNAs, ribozymes, catalytic DNA, tRNA, RNAs that induce triple helix formation, aptamers or vectors may comprise at least one modification or substitution. In some embodiments, the modification is selected from a chemical substitution of the nucleic acid at a sugar position, a chemical substitution at a phosphate position and a chemical substitution at a base position. In other embodiments, the chemical modification is selected from incorporation of a modified nucleotide; 3' capping; conjugation to a high molecular weight, non-immunogenic compound; conjugation to a lipophilic compound; and incorporation of phosphorothioate into the phosphate backbone. In a preferred embodiment, the high molecular weight, non-immunogenic compound is polyalkylene glycol, and more preferably is polyethylene glycol (PEG).

In one embodiment, C/EBPα-saRNA may be attached to a transgene so it can be co-expressed from an RNA polymerase II promoter. In a non-limiting example, C/EBPα-saRNA is attached to green fluorescent protein gene (GFP).

In one embodiment, C/EBPα-saRNA may be attached to a DNA or RNA aptamer, thereby producing C/EBPα-saRNA-aptamer conjugate. Aptamers are oligonucleotides or peptides with high selectivity, affinity and stability. They assume specific and stable three-dimensional shapes, thereby providing highly specific, tight binding to target molecules. An aptamer may be a nucleic acid species that has been engineered through repeated rounds of in vitro selection or equivalently, SELEX (systematic evolution of ligands by exponential enrichment) to bind to various molecular targets such as small molecules, proteins, nucleic acids, and even cells, tissues and organisms. Nucleic acid aptamers have specific binding affinity to molecules through interactions other than classic Watson-Crick base pairing. Nucleic acid aptamers, like peptides generated by phage display or monoclonal antibodies (mAbs), are capable of specifically binding to selected targets and, through binding, block their targets' ability to function. In some cases, aptamers may also be peptide aptamers. For any specific molecular target, nucleic acid aptamers can be identified from combinatorial libraries of nucleic acids, e.g. by SELEX. Peptide aptamers may be identified using a yeast two hybrid system. A skilled person is therefore able to design suitable aptamers for delivering the saRNAs or cells of the present invention to target cells such as liver cells. DNA aptamers, RNA aptamers and peptide aptamers are contemplated. Administration of saRNA of the present invention to the liver using liver-specific aptamers is particularly preferred.

As used herein, a typical nucleic acid aptamer is approximately 10-15 kDa in size (20-45 nucleotides), binds its target with at least nanomolar affinity, and discriminates against closely related targets. Nucleic acid aptamers may be ribonucleic acid, deoxyribonucleic acid, or mixed ribonucleic acid and deoxyribonucleic acid. Aptamers may be single stranded ribonucleic acid, deoxyribonucleic acid or mixed ribonucleic acid and deoxyribonucleic acid. Aptamers may comprise at least one chemical modification.

A suitable nucleotide length for an aptamer ranges from about 15 to about 100 nucleotides (nt), and in various other preferred embodiments, 15-30 nt, 20-25 nt, 30-100 nt, 30-60 nt, 25-70 nt, 25-60 nt, 40-60 nt, 25-40 nt, 30-40 nt, any of 22, 23, 24, 25, 26, 27, 28, 29, 30, 31, 32, 33, 34, 35, 36, 37, 38, 39 or 40 nt or 40-70 nt in length. However, the sequence can be designed with sufficient flexibility such that it can accommodate interactions of aptamers with two targets at the distances described herein. Aptamers may be further modified to provide protection from nuclease and other enzymatic activities. The aptamer sequence can be modified by any suitable methods known in the art.

The C/EBPα-saRNA-aptamer conjugate may be formed using any known method for linking two moieties, such as direct chemical bond formation, linkage via a linker such as streptavidin and so on.

In one embodiment, C/EBPα-saRNA may be attached to an antibody. Methods of generating antibodies against a target cell surface receptor are well known. The saRNA molecules of the invention may be attached to such antibodies with known methods, for example using RNA carrier proteins. The resulting complex may then be administered to a subject and taken up by the target cells via receptor-mediated endocytosis.

In one embodiment, C/EBPα-saRNA may be conjugated with lipid moieties such as a cholesterol moiety (Letsinger et al., Proc. Natl. Acad. Sci. USA, 1989, 86: 6553-6556), cholic acid (Manoharan et al., Biorg. Med. Chem. Let., 1994, 4:1053-1060), a thioether, e.g., beryl-5-tritylthiol (Manoharan et al., Ann. N.Y. Acad. Sci., 1992, 660:306-309; Manoharan et al., Biorg. Med. Chem. Let., 1993, 3:2765-2770), a thiocholesterol (Oberhauser et al., Nucl. Acids Res., 1992, 20:533-538), an aliphatic chain, e.g., dodecandiol or undecyl residues (Saison-Behmoaras et al., EMBO J, 1991, 10:1111-1118; Kabanov et al., FEBS Lett., 1990, 259:327-330; Svinarchuk et al., Biochimie, 1993, 75:49-54), a phospholipid, e.g., di-hexadecyl-rac-glycerol or triethyl-ammonium 1,2-di-O-hexadecyl-rac-glycero-3-Hphosphonate (Manoharan et al., Tetrahedron Lett., 1995, 36:3651-3654; Shea et al., Nucl. Acids Res., 1990, 18:3777-3783), a polyamine or a polyethylene glycol chain (Manoharan et al., Nucleosides & Nucleotides, 1995, 14:969-973), or adamantane acetic acid (Manoharan et al., Tetrahedron Lett., 1995, 36:3651-3654), a palmityl moiety (Mishra et al., Biochim.

Biophys. Acta, 1995, 1264:229-237), or an octadecylamine or hexylamino-carbonyloxycholesterol moiety (Crooke et al., J. Pharmacol. Exp. Ther., 1996, 277:923-937), the content of each of which is herein incorporated by reference in its entirety.

In one embodiment, the saRNA of the present invention is conjugated with a ligand disclosed in US 20130184328 to Manoharan et al., the contents of which are incorporated herein by reference in their entirety. The conjugate has a formula of Ligand-[linker]$_{optional}$-[tether]$_{optional}$-oligonucleotide agent. The oligonucleotide agent may comprise a subunit having formulae (I) disclosed by US 20130184328 to Manoharan et al., the contents of which are incorporated herein by reference in their entirety.

Representative U.S. patents that teach the preparation of such nucleic acid/lipid conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203; 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, the content of each of which is herein incorporated by reference in its entirety.

The saRNA of the present invention may be provided in combination with other active ingredients known to have an effect in the particular method being considered. The other active ingredients may be administered simultaneously, separately, or sequentially with the saRNA of the present invention. In one embodiment, C/EBPα-saRNA is administered with saRNA modulating a different target gene. Non-limiting examples include saRNA that modulates albumin, insulin or HNF4A genes. Modulating any gene may be achieved using a single saRNA or a combination of two or more different saRNAs. Non-limiting examples of saRNA that can be administered with C/EBPα-saRNA of the present invention include saRNA modulating albumin or HNF4A disclosed in International Publication WO 2012/175958 filed Jun. 20, 2012, saRNA modulating insulin disclosed in International Publications WO 2012/046084 and WO 2012/046085 both filed Oct. 10, 2011, saRNA modulating human progesterone receptor, human major vault protein (hMVP), E-cadherin gene, p53 gene, or PTEN gene disclosed in U.S. Pat. No. 7,709,456 filed Nov. 13, 2006 and US Pat. Publication US 2010/0273863 filed Apr. 23, 2010, and saRNAs targeting p21 gene disclosed in International Publication WO 2006/113246 filed Apr. 11, 2006, the contents of each of which are incorporated herein by reference in their entirety.

In one embodiment, C/EBPα-saRNA is administered with a small interfering RNA or siRNA that inhibits the expression of C/EBPβ gene, i.e., C/EBPβ-siRNA. Preferred sequences of suitable siRNAs of the invention are provided in Table 3.

TABLE 3 siRNA sequences

| ID | C/EBPβ-si-1 | C/EBPβ-si-2 |
|---|---|---|
| Target | Ctgagtaatcgcttaaaga (SEQ ID NO: 253) | gaaactttagcgagtcaga (SEQ ID NO: 254) |
| Efficacy | 0.7 | 0.52 |
| Location | 1892 | 239 |
| Sense (passenger) | CUGAGUAAUCGCUUAAAGA UU (SEQ ID NO. 29) | GAAACUUUAGCGAGUCAGA UU (SEQ ID NO. 31) |
| Antisense (guide) | UCUUUAAGCGAUUACUCAG UU (SEQ ID NO. 30) | UCUGACUCGCUAAAGUUUC UU (SEQ ID NO. 32) |

In one embodiment, C/EBPα-saRNA is administered with one or more drugs that regulate metabolics, particularly liver function. In a non-limiting example, C/EBPα-saRNA of the present invention is administered with drugs that decrease low density lipoprotein (LDL) cholesterol levels, such as statin, simvastatin, atorvastatin, rosuvastatin, ezetimibe, niacin, PCSK9 inhibitors, CETP inhibitors, clofibrate, fenofibric, tocotrienols, phytosterols, bile acid sequestrants, probucol, or a combination thereof. C/EBPα-saRNA may also be administered with vanadium biguanide complexes disclosed in U.S. Pat. No. 6,287,586 to Orvig et al. In another example, C/EBPα-saRNA may be administered with a composition disclosed in WO 201102838 to Rhodes, the contents of which are incorporated by reference in their entirety, to lower serum cholesterol. The composition comprises an antigen binding protein that selectively binds to and inhibits a PCSK9 protein; and an RNA effector agent which inhibits the expression of a PCSK9 gene in a cell. In yet another example, C/EBPα-saRNA may be administered with an ABC1 polypeptide having ABC1 biological activity, or a nucleic acid encoding an ABC1 polypeptide having ABC1 activity to modulate cholesterol levels as described in EP1854880 to Brooks-Wilson et al., the contents of which are incorporated herein by reference in their entirety.

In another embodiment, C/EBPα-saRNA of the present invention is administered with drugs that increase insulin sensitivity or treat type II diabetes mellitus, such as metformin, sulfonylurea, nonsulfonylurea secretagogues, α glucosidase inhibitors, thiazolidinediones, pioglitazone, rosiglitazone, glucagon-like peptide-1 analog, and dipeptidyl peptidase-4 inhibitors or a combination thereof. Other hepato-protective agents that may be administered in combination with the saRNA of the present invention are disclosed in Adams et al., *Postgraduate Medical Journal*, vol. 82, 315-322 (2006), the contents of which are incorporated herein by reference in their entirety.

Gankyrin and FXR Protein

The development of hepatocellular carcinoma (HCC) is a multistep process which involves progressive changes of gene expression leading to liver hyperproliferation and to liver cancer. During carcinogenesis of liver cancer, tumor suppressor proteins Rb, p53, hepatocyte nuclear factor 4α (HNF4α), and C/EBP-α are neutralized. The elimination of these proteins is mediated by a small subunit of 26S proteasome, gankyrin, which is activated by cancer. Wang et al. discloses that gankyrin interacts with S193-ph isoform of C/EBPα and targets it for ubiquitinproteasome system (UPS)-mediated degradation. Gankyrin level is elevated during the early stages of liver cancer development (Wang et al., *J. Clin. Invest*, vol. 120(7):2549-2562 (2010), the contents of which are incorporated herein by reference in their entireties). Inhibiting gankyrin, e.g., using siRNA of the gankyrin gene (also known as PSMD10 gene) and/or gankyrin inhibitors, may prevent and/or treat HCC.

Jiang et al. found that farnesoid X receptor (FXR), also known as bile acid receptor (BAR) or NR1H4, inhibits expression of gankyrin in quiescent livers by silencing the gankyrin promoter through HDAC1-C/EBPβ complexes (Jiang et al., *Hepatology*, vol. 57(3):1098-1106 (2013), the contents of which are incorporated herein by reference in their entireties). Deletion of FXR signaling in mice leads to de-repression of the gankyrin promoter and to spontaneous development of liver cancer at 12 months of age. Diethylnitrosoamine (DEN)-mediated liver cancer in wild-type mice also involves the reduction of FXR and activation of gankyrin. Examination of liver cancer in old mice and liver cancer in human patients revealed that FXR is reduced, while gankyrin is elevated during spontaneous development of liver cancer. Jiang et al. concluded that FXR prevents liver cancer by inhibiting the gankyrin promoter via C/EBPβ-HDAC1 complexes leading to subsequent protection of tumor suppressor proteins from degradation. Stabilization and nuclear translocation of FXR inhibits gankyrin. Activating FXR, e.g., using FXR agonists or activators, or activator of NR1H4 gene, may prevent and/or treat HCC.

C/EBPα-saRNA of the present invention may be used in combination with one or more of therapeutic agents that down-regulate gankyrin or up-regulate FXR. The combination may have synergistic effect on preventing and/or treating HCC. In some embodiments, C/EBPα-saRNA of the present invention may be used in combination with gankyrin-siRNA. Double-stranded Gankyrin-siRNA may be produced using the method disclosed by Higashitsuji et al. in the 'Inhibition of endogenous gene expression by RNAi' section (Higashitsuji et al., *Cancer Cell*, vol. 8:75-87 (2005), the contents of which are incorporated herein by reference in their entireties). In some embodiments, C/EBPα-saRNA of the present invention may be used in combination with FXR agonists. Non-limiting examples of FXR agonists or activators include taurocholic acid, obeticholic acid (OCA), INT-767 (Intercept Pharmaceuticals), INT-777 (Intercept Pharmaceuticals), and any FXR agonist or activator disclosed in US Pat. App. No. 20140057886, U.S. Pat. Nos. 8,546,365, 7,932,244, US Pat. App. No. 20140100209, U.S. Pat. Nos. 8,445,472, 8,114,862, US Pat. App. No. 20140094443, U.S. Pat. Nos. 8,410,083, 8,796,249, US Pat. App. No. 20140024631, U.S. Pat. Nos. 8,377,916, 8,258, 267, 7,786,102, 7,138,390, 7,994,352, 7,858,608, 7,812,011, US Pat. App. No. 20140148428, and US Pat. App. No. 20060252670 (the contents of each of which are incorporated herein by reference in their entirety).

Formulation, Delivery, Administration, and Dosing

Pharmaceutical formulations may additionally comprise a pharmaceutically acceptable excipient, which, as used herein, includes, but is not limited to, any and all solvents, dispersion media, diluents, or other liquid vehicles, dispersion or suspension aids, surface active agents, isotonic agents, thickening or emulsifying agents, preservatives, and the like, as suited to the particular dosage form desired. Various excipients for formulating pharmaceutical compositions and techniques for preparing the composition are known in the art (see Remington: The Science and Practice of Pharmacy, 21$^{st}$ Edition, A. R. Gennaro, Lippincott, Williams & Wilkins, Baltimore, Md., 2006; incorporated herein by reference in its entirety). The use of a conventional excipient medium may be contemplated within the scope of the present disclosure, except insofar as any conventional excipient medium may be incompatible with a substance or its derivatives, such as by producing any undesirable biological effect or otherwise interacting in a deleterious manner with any other component(s) of the pharmaceutical composition.

In some embodiments, compositions are administered to humans, human patients or subjects. For the purposes of the present disclosure, the phrase "active ingredient" generally refers to C/EBPα-saRNA to be delivered as described herein.

Although the descriptions of pharmaceutical compositions provided herein are principally directed to pharmaceutical compositions which are suitable for administration to humans, it will be understood by the skilled artisan that such compositions are generally suitable for administration to any other animal, e.g., to non-human animals, e.g. non-human mammals. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, dividing, shaping and/or packaging the product into a desired single- or multi-dose unit.

A pharmaceutical composition in accordance with the invention may be prepared, packaged, and/or sold in bulk, as a single unit dose, and/or as a plurality of single unit doses. As used herein, a "unit dose" is discrete amount of the pharmaceutical composition comprising a predetermined amount of the active ingredient. The amount of the active ingredient is generally equal to the dosage of the active ingredient which would be administered to a subject and/or a convenient fraction of such a dosage such as, for example, one-half or one-third of such a dosage.

Relative amounts of the active ingredient, the pharmaceutically acceptable excipient, and/or any additional ingredients in a pharmaceutical composition in accordance with the invention will vary, depending upon the identity, size, and/or condition of the subject treated and further depending upon the route by which the composition is to be administered. By way of example, the composition may comprise between 0.1% and 100%, e.g., between 0.5 and 50%, between 1-30%, between 5-80%, at least 80% (w/w) active ingredient.

In some embodiments, the formulations described herein may contain at least one saRNA. As a non-limiting example, the formulations may contain 1, 2, 3, 4 or 5 saRNAs with different sequences. In one embodiment, the formulation contains at least three saRNAs with different sequences. In one embodiment, the formulation contains at least five saRNAs with different sequences.

The saRNA of the invention can be formulated using one or more excipients to: (1) increase stability; (2) increase cell transfection; (3) permit the sustained or delayed release (e.g., from a depot formulation of the saRNA); (4) alter the biodistribution (e.g., target the saRNA to specific tissues or cell types); (5) increase the translation of encoded protein in vivo; and/or (6) alter the release profile of encoded protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with saRNA (e.g., for transplantation into a subject), hyaluronidase, nanoparticle mimics and combinations thereof. Accordingly, the formulations of the invention can include one or more excipients, each in an amount that together increases the stability of the saRNA and/or increases cell transfection by the saRNA. Further, the saRNA of the present invention may be formulated using self-assembled nucleic acid nanoparticles. Pharmaceutically acceptable carriers, excipients, and delivery agents for nucleic acids that may be used in the formulation with the saRNA of the present invention are disclosed in International Publication WO 2013/090648 filed Dec. 14, 2012, the contents of which are incorporated herein by reference in their entirety.

In one embodiment, the saRNA of the present invention comprises two single RNA strands that are 21 nucleotides in length each that are annealed to form a double stranded C/EBPα-saRNA as the active ingredient. The composition further comprises a salt buffer composed of 50 mM Tris-HCl, pH 8.0, 100 mM NaCl and 5 mM EDTA.

In another embodiment, the saRNA of the present invention may be delivered with dendrimers. Dendrimers are highly branched macromolecules. In a preferred embodiment, the saRNA of the present invention is complexed with structurally flexible poly(amidoamine) (PAMAM) dendrimers for targeted in vivo delivery. The complex is called C/EBPα-saRNA-dendrimers. Dendrimers have a high degree of molecular uniformity, narrow molecular weight distribution, specific size and shape characteristics, and a highly-functionalized terminal surface. The manufacturing process is a series of repetitive steps starting with a central initiator core. Each subsequent growth step represents a new generation of polymers with a larger molecular diameter and molecular weight, and more reactive surface sites than the preceding generation. PAMAM dendrimers are efficient nucleotide delivery systems that bear primary amine groups on their surface and also a tertiary amine group inside of the structure. The primary amine group participates in nucleotide binding and promotes their cellular uptake, while the buried tertiary amino groups act as a proton sponge in endosomes and enhance the release of nucleic acid into the cytoplasm. These dendrimers protect the saRNA carried by them from ribonuclease degradation and achieves substantial release of saRNA over an extended period of time via endocytosis for efficient gene targeting. The in vivo efficacy of these nanoparticles have previously been evaluated where biodistribution studies show that the dendrimers preferentially accumulate in peripheral blood mononuclear cells and live with no discernible toxicity (see Zhou et al., Molecular Ther. 2011 Vol. 19, 2228-2238, the contents of which are incorporated herein by reference in their entirety). PAMAM dendrimers may comprise a triethanolamine (TEA) core, a diaminobutane (DAB) core, a cystamine core, a diaminohexane (HEX) core, a diamonododecane (DODE) core, or an ethylenediamine (EDA) core. Preferably, PAMAM dendrimers comprise a TEA core or a DAB core.

Lipidoids

The synthesis of lipidoids has been extensively described and formulations containing these compounds are particularly suited for delivery of oligonucleotides or nucleic acids (see Mahon et al., Bioconjug Chem. 2010 21:1448-1454; Schroeder et al., J Intern Med. 2010 267:9-21; Akinc et al., Nat Biotechnol. 2008 26:561-569; Love et al., Proc Natl Acad Sci USA. 2010 107:1864-1869; Siegwart et al., Proc Natl Acad Sci USA. 2011 108:12996-3001; all of which are incorporated herein in their entireties).

While these lipidoids have been used to effectively deliver double stranded small interfering RNA molecules in rodents and non-human primates (see Akinc et al., Nat Biotechnol. 2008 26:561-569; Frank-Kamenetsky et al., Proc Natl Acad Sci USA. 2008 105:11915-11920; Akinc et al., Mol Ther. 2009 17:872-879; Love et al., Proc Natl Acad Sci USA. 2010 107:1864-1869; Leuschner et al., Nat Biotechnol. 2011 29:1005-1010; all of which is incorporated herein in their entirety), the present disclosure describes their formulation and use in delivering saRNA. Complexes, micelles, liposomes or particles can be prepared containing these lipidoids and therefore, can result in an effective delivery of the saRNA following the injection of a lipidoid formulation via localized and/or systemic routes of administration. Lipidoid complexes of saRNA can be administered by various means including, but not limited to, intravenous, intramuscular, or subcutaneous routes.

In vivo delivery of nucleic acids may be affected by many parameters, including, but not limited to, the formulation composition, nature of particle PEGylation, degree of loading, oligonucleotide to lipid ratio, and biophysical parameters such as, but not limited to, particle size (Akinc et al., Mol Ther. 2009 17:872-879; the contents of which are herein incorporated by reference in its entirety). As an example, small changes in the anchor chain length of poly(ethylene glycol) (PEG) lipids may result in significant effects on in vivo efficacy. Formulations with the different lipidoids, including, but not limited to penta[3-(1-laurylaminopropionyl)]-triethylenetetramine hydrochloride (TETA-5LAP; aka 98N12-5, see Murugaiah et al., Analytical Biochemistry, 401:61 (2010); the contents of which are herein incorporated by reference in its entirety), C12-200 (including derivatives and variants), and MD1, can be tested for in vivo activity.

The lipidoid referred to herein as "98N12-5" is disclosed by Akinc et al., Mol Ther. 2009 17:872-879 and the contents of which is incorporated by reference in its entirety. (See FIG. 2)

The lipidoid referred to herein as "C12-200" is disclosed by Love et al., Proc Natl Acad Sci USA. 2010 107:1864-1869 (see FIG. 2) and Liu and Huang, Molecular Therapy. 2010 669-670 (see FIG. 2); the contents of both of which are herein incorporated by reference in their entirety. The lipidoid formulations can include particles comprising either 3 or 4 or more components in addition to the saRNA. As an example, formulations with certain lipidoids, include, but are not limited to, 98N12-5 and may contain 42% lipidoid, 48% cholesterol and 10% PEG (C14 alkyl chain length). As another example, formulations with certain lipidoids, include, but are not limited to, C12-200 and may contain 50% lipidoid, 10% disteroylphosphatidyl choline, 38.5% cholesterol, and 1.5% PEG-DMG.

In one embodiment, a saRNA formulated with a lipidoid for systemic intravenous administration can target the liver. For example, a final optimized intravenous formulation using saRNA and comprising a lipid molar composition of 42% 98N12-5, 48% cholesterol, and 10% PEG-lipid with a final weight ratio of about 7.5 to 1 total lipid to saRNA and a C14 alkyl chain length on the PEG lipid, with a mean particle size of roughly 50-60 nm, can result in the distribution of the formulation to be greater than 90% to the liver. (see, Akinc et al., Mol Ther. 2009 17:872-879; the contents of which are herein incorporated by reference in its entirety). In another example, an intravenous formulation using a C12-200 (see U.S. provisional application 61/175,770 and published international application WO2010129709, the contents of each of which is herein incorporated by reference in their entirety) lipidoid may have a molar ratio of 50/10/38.5/1.5 of C12-200/disteroylphosphatidyl choline/cholesterol/PEG-DMG, with a weight ratio of 7 to 1 total lipid to nucleic acid and a mean particle size of 80 nm may be effective to deliver saRNA (see, Love et al., Proc Natl Acad Sci USA. 2010 107:1864-1869, the contents of which are herein incorporated by reference in its entirety). In another embodiment, an MD1 lipidoid-containing formulation may be used to effectively deliver saRNA to hepatocytes in vivo. The characteristics of optimized lipidoid formulations for intramuscular or subcutaneous routes may vary significantly depending on the target cell type and the ability of formulations to diffuse through the extracellular matrix into the blood stream. While a particle size of less than 150 nm may be desired for effective hepatocyte delivery due to the size of the endothelial fenestrae (see, Akinc et al., Mol Ther. 2009 17:872-879, the contents of which are herein incorporated by reference in its entirety), use of a lipidoid-formulated saRNA to deliver the formulation to other cells types including, but not limited to, endothelial cells, myeloid cells, and muscle cells may not be similarly size-limited. Use of lipidoid formulations to deliver siRNA in vivo to other non-hepatocyte cells such as myeloid cells and endothelium has been reported (see Akinc et al., Nat Biotechnol. 2008 26:561-569; Leuschner et al., Nat Biotechnol. 2011 29:1005-1010; Cho et al. Adv. Funct. Mater. 2009 19:3112-3118; 8$^{th}$ International Judah Folkman Conference, Cambridge, Mass. Oct. 8-9, 2010; the contents of each of which is herein incorporated by reference in its entirety). Effective delivery to myeloid cells, such as monocytes, lipidoid formulations may have a similar component molar ratio. Different ratios of lipidoids and other components including, but not limited to, disteroylphosphatidyl choline, cholesterol and PEG-DMG, may be used to optimize the formulation of saRNA for delivery to different cell types including, but not limited to, hepatocytes, myeloid cells, muscle cells, etc. For example, the component molar ratio may include, but is not limited to, 50% C12-200, 10% disteroylphosphatidyl choline, 38.5% cholesterol, and %1.5 PEG-DMG (see Leuschner et al., Nat Biotechnol 2011 29:1005-1010; the contents of which are herein incorporated by reference in its entirety). The use of lipidoid formulations for the localized delivery of nucleic acids to cells (such as, but not limited to, adipose cells and muscle cells) via either subcutaneous or intramuscular delivery, may not require all of the formulation components desired for systemic delivery, and as such may comprise only the lipidoid and saRNA.

Liposomes, Lipoplexes, and Lipid Nanoparticles

The saRNA of the invention can be formulated using one or more liposomes, lipoplexes, or lipid nanoparticles. In one embodiment, pharmaceutical compositions of saRNA include liposomes. Liposomes are artificially-prepared vesicles which may primarily be composed of a lipid bilayer and may be used as a delivery vehicle for the administration of nutrients and pharmaceutical formulations. Liposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 and 500 nm in diameter. Liposome design may include, but is not limited to, opsonins or ligands in order to improve the attachment of liposomes to unhealthy tissue or to activate events such as, but not limited to, endocytosis. Liposomes may contain a low or a high pH in order to improve the delivery of the pharmaceutical formulations.

The formation of liposomes may depend on the physicochemical characteristics such as, but not limited to, the pharmaceutical formulation entrapped and the liposomal ingredients, the nature of the medium in which the lipid vesicles are dispersed, the effective concentration of the entrapped substance and its potential toxicity, any additional processes involved during the application and/or delivery of the vesicles, the optimization size, polydispersity and the shelf-life of the vesicles for the intended application, and the batch-to-batch reproducibility and possibility of large-scale production of safe and efficient liposomal products.

In one embodiment, pharmaceutical compositions described herein may include, without limitation, liposomes such as those formed from 1,2-dioleyloxy-N,N-dimethylaminopropane (DODMA) liposomes, DiLa2 liposomes from Marina Biotech (Bothell, Wash.), 1,2-dilinoleyloxy-3-dimethylaminopropane (DLin-DMA), 2,2-dilinoleyl-4-(2-dimethylaminoethyl)-[1,3]-dioxolane (DLin-KC2-DMA), and MC3 (US20100324120; the contents of which are herein incorporated by reference in its entirety) and liposomes which may deliver small molecule drugs such as, but not limited to, DOXIL® from Janssen Biotech, Inc. (Horsham, Pa.).

In one embodiment, pharmaceutical compositions described herein may include, without limitation, liposomes such as those formed from the synthesis of stabilized plasmid-lipid particles (SPLP) or stabilized nucleic acid lipid particle (SNALP) that have been previously described and shown to be suitable for oligonucleotide delivery in vitro and in vivo (see Wheeler et al. Gene Therapy. 1999 6:271-281; Zhang et al. Gene Therapy. 1999 6:1438-1447; Jeffs et al. Pharm Res. 2005 22:362-372; Morrissey et al., Nat Biotechnol. 2005 2:1002-1007; Zimmermann et al., Nature. 2006 441:111-114; Heyes et al. J Contr Rel. 2005 107:276-287; Semple et al. Nature Biotech. 2010 28:172-176; Judge et al. J Clin Invest. 2009 119:661-673; deFougerolles *Hum Gene Ther.* 2008 19:125-132; the contents of each of which are incorporated herein in their entireties). The original manufacture method by Wheeler et al. was a detergent dialysis method, which was later improved by Jeffs et al. and is referred to as the spontaneous vesicle formation method. The liposome formulations may be composed of 3 to 4 lipid components in addition to the saRNA. As an example a liposome can contain, but is not limited to, 55% cholesterol, 20% disteroylphosphatidyl choline (DSPC), 10% PEG-S-DSG, and 15% 1,2-dioleyloxy-N,N-dimethylaminopropane (DODMA), as described by Jeffs et al. In another example, certain liposome formulations may contain, but are not limited to, 48% cholesterol, 20% DSPC, 2% PEG-c-DMA, and 30% cationic lipid, where the cationic lipid can be 1,2-distearloxy-N,N-dimethylaminopropane (DSDMA), DODMA, DLin-DMA, or 1,2-dilinolenyloxy-3-dimethyl-aminopropane (DLenDMA), as described by Heyes et al. In another example, the nucleic acid-lipid particle may comprise a cationic lipid comprising from about 50 mol % to about 85 mol % of the total lipid present in the particle; a non-cationic lipid comprising from about 13 mol % to about 49.5 mol % of the total lipid present in the particle; and a conjugated lipid that inhibits aggregation of particles comprising from about 0.5 mol % to about 2 mol % of the total lipid present in the particle as described in WO2009127060 to Maclachlan et al, the contents of which are incorporated herein by reference in their entirety. In another example, the nucleic acid-lipid particle may be any nucleic acid-lipid particle disclosed in US2006008910 to Maclachlan et al., the contents of which are incorporated herein by reference in their entirety. As a non-limiting example, the nucleic acid-lipid particle may comprise a cationic lipid of Formula I, a non-cationic lipid, and a conjugated lipid that inhibits aggregation of particles.

In one embodiment, the saRNA may be formulated in a lipid vesicle which may have crosslinks between functionalized lipid bilayers.

In one embodiment, the liposome may contain a sugar-modified lipid disclosed in U.S. Pat. No. 5,595,756 to Bally et al., the contents of which are incorporated herein by reference in their entirety. The lipid may be a ganglioside and cerebroside in an amount of about 10 mol percent.

In one embodiment, the saRNA may be formulated in a liposome comprising a cationic lipid. The liposome may have a molar ratio of nitrogen atoms in the cationic lipid to the phosphates in the saRNA (N:P ratio) of between 1:1 and 20:1 as described in International Publication No. WO2013006825, the contents of which are herein incorporated by reference in its entirety. In another embodiment, the liposome may have a N:P ratio of greater than 20:1 or less than 1:1.

In one embodiment, the saRNA may be formulated in a lipid-polycation complex. The formation of the lipid-polycation complex may be accomplished by methods known in the art and/or as described in U.S. Pub. No. 20120178702, the contents of which are herein incorporated by reference in its entirety. As a non-limiting example, the polycation may include a cationic peptide or a polypeptide such as, but not limited to, polylysine, polyornithine and/or polyarginine and the cationic peptides described in International Pub. No. WO2012013326; herein incorporated by reference in its entirety. In another embodiment, the saRNA may be formulated in a lipid-polycation complex which may further include a neutral lipid such as, but not limited to, cholesterol or dioleoyl phosphatidylethanolamine (DOPE).

The liposome formulation may be influenced by, but not limited to, the selection of the cationic lipid component, the degree of cationic lipid saturation, the nature of the PEGylation, ratio of all components and biophysical parameters such as size. In one example by Semple et al. (Semple et al. Nature Biotech. 2010 28:172-176; the contents of which are herein incorporated by reference in its entirety), the liposome formulation was composed of 57.1% cationic lipid, 7.1% dipalmitoylphosphatidylcholine, 34.3% cholesterol, and 1.4% PEG-c-DMA.

In some embodiments, the ratio of PEG in the lipid nanoparticle (LNP) formulations may be increased or decreased and/or the carbon chain length of the PEG lipid may be modified from C14 to C18 to alter the pharmacokinetics and/or biodistribution of the LNP formulations. As a non-limiting example, LNP formulations may contain 1-5% of the lipid molar ratio of PEG-c-DOMG as compared to the cationic lipid, DSPC and cholesterol. In another embodiment the PEG-c-DOMG may be replaced with a PEG lipid such as, but not limited to, PEG-DSG (1,2-Distearoyl-sn-glycerol, methoxypolyethylene glycol) or PEG-DPG (1,2-Dipalmitoyl-sn-glycerol, methoxypolyethylene glycol). The cationic lipid may be selected from any lipid known in the art such as, but not limited to, DLin-MC3-DMA, DLin-DMA, C12-200 and DLin-KC2-DMA.

In one embodiment, the saRNA may be formulated in a lipid nanoparticle such as the lipid nanoparticles described in International Publication No. WO2012170930, the contents of which are herein incorporated by reference in its entirety.

In one embodiment, the cationic lipid which may be used in formulations of the present invention may be selected from, but not limited to, a cationic lipid described in International Publication Nos. WO2012040184, WO2011153120, WO2011149733, WO2011090965, WO2011043913, WO2011022460, WO2012061259, WO2012054365, WO2012044638, WO2010080724, WO201021865 and WO2008103276, U.S. Pat. Nos. 7,893,302, 7,404,969 and 8,283,333 and US Patent Publication No. US20100036115 and US20120202871; the contents of each of which is herein incorporated by reference in their entirety. In another embodiment, the cationic lipid may be selected from, but not limited to, formula A described in International Publication Nos. WO2012040184, WO2011153120, WO2011149733, WO2011090965, WO2011043913, WO2011022460, WO2012061259, WO2012054365 and WO2012044638; the contents of each of which is herein incorporated by reference in their entirety. In yet another embodiment, the cationic lipid may be selected from, but not limited to, formula CLI-CLXXIX of International Publication No. WO2008103276, formula CLI-CLXXIX of U.S. Pat. No. 7,893,302, formula CLI-CLXXXII of U.S. Pat. No. 7,404,969 and formula I-VI of US Patent Publication No. US20100036115; the contents of each of which is herein incorporated by reference in their entirety. In yet another embodiment, the cationic lipid may be a multivalent cationic lipid such as the cationic lipid disclosed in U.S. Pat. No. 7,223,887 to Gaucheron et al., the contents of which are incorporated herein by reference in their entirety. The cationic lipid may have a positively-charged head group including two quaternary amine groups and a hydrophobic portion including four hydrocarbon chains as described in U.S. Pat. No. 7,223,887 to Gaucheron et al., the contents of which are incorporated herein by reference in their entirety. In yet another embodiment, the cationic lipid may be biodegradable as the biodegradable lipids disclosed in US20130195920 to Maier et al., the contents of which are incorporated herein by reference in their entirety. The cationic lipid may have one or more biodegradable groups located in a lipidic moiety of the cationic lipid as described in formula I-IV in US 20130195920 to Maier et al., the contents of which are incorporated herein by reference in their entirety. As a non-limiting example, the cationic lipid may be selected from (20Z,23Z)—N,N-dimethylnonacosa-20,23-dien-10-amine, (17Z,20Z)—N,N-dimemylhexacosa-17,20-dien-9-amine, (1Z,19Z)—N5N-dimethylpentacosa-16,19-dien-8-amine, (13Z,16Z)—N,N-dimethyldocosa-13,16-dien-5-amine, (12Z,15Z)—N,N-dimethylhenicosa-12,15-dien-4-amine, (14Z,17Z)—N,N-dimethyltricosa-14,17-dien-6-amine, (15Z,18Z)—N,N-dimethyltetracosa-15,18-dien-7-amine, (18Z,21Z)—N,N-dimethylheptacosa-18,21-dien-10-amine, (15Z,18Z)—N,N-dimethyltetracosa-15,18-dien-5-amine, (14Z,17Z)—N,N-dimethyltricosa-14,17-dien-4-amine, (19Z,22Z)—N,N-dimeihyloctacosa-19,22-dien-9-amine, (18Z,21 Z)—N,N-dimethylheptacosa-18,21-dien-8-amine, (17Z,20Z)—N,N-dimethylhexacosa-17,20-dien-7-amine, (16Z,19Z)—N,N-dimethylpentacosa-16,19-dien-6-amine, (22Z,25Z)—N,N-dimethylhentriaconta-22,25-dien-10-amine, (21 Z,24Z)—N,N-dimethyltriaconta-21,24-dien- 9-amine, (18Z)—N,N-dimetylheptacos-18-en-10-amine, (17Z)—N,N-dimethylhexacos-17-en-9-amine, (19Z,22Z)—N,N-dimethyloctacosa-19,22-dien-7-amine, N,N-dimethylheptacosan-10-amine, (20Z,23Z)—N-ethyl-N-methylnonacosa-20,23-dien-10-amine, 1-[(11Z,14Z)-1-nonylicosa-11,14-dien-1-yl]pyrrolidine, (20Z)—N,N-dimethylheptacos-20-en-10-amine, (15Z)—N,N-dimethyl eptacos-15-en-10-amine, (14Z)—N,N-dimethylnonacos-14-en-10-amine, (17Z)—N,N-dimethylnonacos-17-en-10-amine, (24Z)—N,N-dimethyltritriacont-24-en-10-amine, (20Z)—N,N-dimethylnonacos-20-en-10-amine, (22Z)—N,N-dimethylhentriacont-22-en-10-amine, (16Z)—N,N-dimethylpentacos-16-en-8-amine, (12Z,15Z)—N,N-dimethyl-2-nonylhenicosa-12,15-dien-1-amine, (13Z,16Z)—N,N-dimethyl-3-nonyldocosa-13,16-dien-1-amine, N,N-dimethyl-1-[(1S,2R)-2-octylcyclopropyl]eptadecan-8-amine, 1-[(1S,2R)-2-hexylcyclopropyl]-N,N-dimethylnonadecan-10-amine, N,N-dimethyl-1-[(1S,2R)-2-octylcyclopropyl]nonadecan-10-amine, N,N-dimethyl-21-[(1S,2R)-2-octylcyclopropyl]henicosan-10-amine, N,N-dimethyl-1-[(1S,2S)-2-{[(1R,2R)-2-pentylcyclopropyl]methyl}cyclopropyl]nonadecan-10-amine,N,N-dimethyl-1-[(1S,2R)-2-octylcyclopropyl]hexadecan-8-amine, N,N-dimethyl-[(1R,2S)-2-undecylcyclopropyl]tetradecan-5-amine, N,N-dimethyl-3-{7-[(1S,2R)-2-octylcyclopropyl]heptyl}dodecan-1-amine, 1-[(1R,2S)-2-heptylcyclopropyl]-N,N-dimethyloctadecan-9-amine, 1-[(1S,2R)-2-decylcyclopropyl]-N,N-dimethylpentadecan-6-amine, N,N-dimethyl-1-[(1S,2R)-2-octylcyclopropyl]pentadecan-8-amine, R—N,N-dimethyl-1-[(9Z,12Z)-octadeca-9,12-dien-1-yloxy]-3-(octyloxy)propan-2-amine, S—N,N-dimethyl-1-[(9Z,12Z)-octadeca-9,12-dien-1-yloxy]-3-(octyloxy)propan-2-amine, 1-{2-[(9Z,12Z)-octadeca-9,12-dien-1-yloxy]-1-[(octyloxy)methyl]ethyl}pyrrolidine, (2S)—N,N-dimethyl-1-[(9Z,12Z)-octadeca-9,12-dien-1-yloxy]-3-[(5Z)-oct-5-en-1-yloxy]propan-2-amine, 1-{2-[(9Z,12Z)-octadeca-9,12-dien-1-yloxy]-1-[(octyloxy)methyl]ethyl}azetidine, (2S)-1-(hexyloxy)-N,N-dimethyl-3-[(9Z,12Z)-octadeca-9,12-dien-1-yloxy]propan-2-amine, (2S)-1-(heptyloxy)-N,N-dimethyl-3-[(9Z,12Z)-octadeca-9,12-dien-1-yloxy]propan-2-amine, N,N-dimethyl-1-(nonyloxy)-3-[(9Z,12Z)-octadeca-9,12-dien-1-yloxy]propan-2-amine, N,N-dimethyl-1-[(9Z)-octadec-9-en-1-yloxy]-3-(octyloxy)propan-2-amine; (2S)—N,N-dimethyl-1-[(6Z,9Z,12Z)-octadeca-6,9,12-trien-1-yloxy]-3-(octyloxy)propan-2-amine, (2S)-1-[(11Z,14Z)-icosa-11,14-dien-1-yloxy]-N,N-dimethyl-3-(pentyloxy)propan-2-amine, (2S)-1-(hexyloxy)-3-[(11Z,14Z)-icosa-11,14-dien-1-yloxy]-N,N-dimethylpropan-2-amine, 1-[(11Z,14Z)-icosa-11,14-dien-1-yloxy]-N,N-dimethyl-3-(octyloxy)propan-2-amine, 1-[(13Z,16Z)-docosa-13,16-dien-1-yloxy]-N,N-dimethyl-3-(octyloxy)propan-2-amine, (2S)-1-[(13Z,16Z)-docosa-13,16-dien-1-yloxy]-3-(hexyloxy)-N,N-dimethylpropan-2-amine, (2 S)-1-[(13Z)-docos-13-en-1-yloxy]-3-(hexyloxy)-N,N-dimethylpropan-2-amine, 1-[(13Z)-docos-13-en-1-yloxy]-N,N-dimethyl-3-(octyloxy)propan-2-amine, 1-[(9Z)-hexadec-9-en-1-yloxy]-N,N-dimethyl-3-(octyloxy)propan-2-amine, (2R)—N,N-dimethyl-H(1-metoylo ctyl)oxy]-3-[(9Z,12Z)-octadeca-9,12-dien-1-yloxy]propan-2-amine, (2R)-1-[(3,7-dimethyloctyl)oxy]-N,N-dimethyl-3-[(9Z,12Z)-octadeca-9,12-dien-1-yloxy]propan-2-amine, N,N-dimethyl-1-(octyloxy)-3-({8-[(1S,2S)-2-{[(1R,2R)-2-pentylcyclopropyl]methyl}cyclopropyl]octyl}oxy)propan-2-amine, N,N-dimethyl-1-{[8-(2-oclylcyclopropyl)octyl]oxy}-3-(octyloxy)propan-2-amine and (11E,20Z,23Z)—N,N-dimethylnonacosa-11,20,2-trien-10-amine or a pharmaceutically acceptable salt or stereoisomer thereof.

In one embodiment, the lipid may be a cleavable lipid such as those described in International Publication No. WO2012170889, the contents of which is herein incorporated by reference in its entirety.

In one embodiment, the nanoparticles described herein may comprise at least one cationic polymer described herein and/or known in the art.

In one embodiment, the cationic lipid may be synthesized by methods known in the art and/or as described in International Publication Nos. WO2012040184, WO2011153120, WO2011149733, WO2011090965, WO2011043913, WO2011022460, WO2012061259, WO2012054365, WO2012044638, WO2010080724 and WO201021865; the contents of each of which is herein incorporated by reference in their entirety.

In one embodiment, the LNP formulations of the saRNA may contain PEG-c-DOMG at 3% lipid molar ratio. In another embodiment, the LNP formulations of the saRNA may contain PEG-c-DOMG at 1.5% lipid molar ratio.

In one embodiment, the pharmaceutical compositions of the saRNA may include at least one of the PEGylated lipids described in International Publication No. 2012099755, the contents of which is herein incorporated by reference in its entirety.

In one embodiment, the LNP formulation may contain PEG-DMG 2000 (1,2-dimyristoyl-sn-glycero-3-phophoethanolamine-N-[methoxy(polyethylene glycol)-2000). In one embodiment, the LNP formulation may contain PEG-DMG 2000, a cationic lipid known in the art and at least one other component. In another embodiment, the LNP formulation may contain PEG-DMG 2000, a cationic lipid known in the art, DSPC and cholesterol. As a non-limiting example, the LNP formulation may contain PEG-DMG 2000, DLin-DMA, DSPC and cholesterol. As another non-limiting example the LNP formulation may contain PEG-DMG 2000, DLin-DMA, DSPC and cholesterol in a molar ratio of 2:40:10:48 (see e.g., Geall et al., Nonviral delivery of self-amplifying RNA vaccines, PNAS 2012; PMID: 22908294; herein incorporated by reference in its entirety). As another non-limiting example, the saRNA described herein may be formulated in a nanoparticle to be delivered by a parenteral route as described in U.S. Pub. No. 20120207845; the contents of which is herein incorporated by reference in its entirety. The cationic lipid may also be the cationic lipids disclosed in US20130156845 to Manoharan et al. and US 20130129785 to Manoharan et al., WO 2012047656 to Wasan et al., WO 2010144740 to Chen et al., WO 2013086322 to Ansell et al., or WO 2012016184 to Manoharan et al., the contents of each of which are incorporated herein by reference in their entirety.

In one embodiment, the saRNA of the present invention may be formulated with a plurality of cationic lipids, such as a first and a second cationic lipid as described in US20130017223 to Hope et al., the contents of which are incorporated herein by reference in their entirety. The first cationic lipid can be selected on the basis of a first property and the second cationic lipid can be selected on the basis of a second property, where the properties may be determined as outlined in US20130017223, the contents of which are herein incorporated by reference in its entirety. In one embodiment, the first and second properties are complementary.

In another embodiment, the saRNA may be formulated with a lipid particle comprising one or more cationic lipids and one or more second lipids, and one or more nucleic acids, wherein the lipid particle comprises a solid core, as described in US Patent Publication No. US20120276209 to Cullis et al., the contents of which are incorporated herein by reference in their entirety.

In one embodiment, the saRNA of the present invention may be complexed with a cationic amphiphile in an oil-in-water (o/w) emulsion such as described in EP2298358 to Satishchandran et al., the contents of which are incorporated herein by reference in their entirety. The cationic amphiphile may be a cationic lipid, modified or unmodified spermine, bupivacaine, or benzalkonium chloride and the oil may be a vegetable or an animal oil. As a non-limiting example, at least 10% of the nucleic acid-cationic amphiphile complex is in the oil phase of the oil-in-water emulsion (see e.g., the complex described in European Publication No. EP2298358 to Satishchandran et al., the contents of which are herein incorporated by reference in its entirety).

In one embodiment, the saRNA of the present invention may be formulated with a composition comprising a mixture of cationic compounds and neutral lipids. As a non-limiting example, the cationic compounds may be formula (I) disclosed in WO 1999010390 to Ansell et al., the contents of which are disclosed herein by reference in their entirety, and the neutral lipid may be selected from the group consisting of diacylphosphatidylcholine, diacylphosphatidylethanolamine, ceramide and sphingomyelin.

In one embodiment, the LNP formulation may be formulated by the methods described in International Publication Nos. WO2011127255 or WO2008103276, each of which are herein incorporated by reference in their entirety. As a non-limiting example, the saRNA of the present invention may be encapsulated in any of the lipid nanoparticle (LNP) formulations described in WO2011127255 and/or WO2008103276; the contents of each of which are herein incorporated by reference in their entirety.

In one embodiment, the LNP formulations described herein may comprise a polycationic composition. As a non-limiting example, the polycationic composition may be selected from formula 1-60 of US Patent Publication No. US20050222064; the contents of which is herein incorporated by reference in its entirety. In another embodiment, the LNP formulations comprising a polycationic composition may be used for the delivery of the saRNA described herein in vivo and/or in vitro.

In one embodiment, the LNP formulations described herein may additionally comprise a permeability enhancer molecule. Non-limiting permeability enhancer molecules are described in US Patent Publication No. US20050222064; the contents of which is herein incorporated by reference in its entirety.

In one embodiment, the pharmaceutical compositions may be formulated in liposomes such as, but not limited to, DiLa2 liposomes (Marina Biotech, Bothell, Wash.), SMARTICLES®/NOV340 (Marina Biotech, Bothell, Wash.), neutral DOPC (1,2-dioleoyl-sn-glycero-3-phosphocholine) based liposomes (e.g., siRNA delivery for ovarian cancer (Landen et al. Cancer Biology & Therapy 2006 5(12)1708-1713); the contents of which is herein incorporated by reference in its entirety) and hyaluronan-coated liposomes (Quiet Therapeutics, Israel). In some embodiments, the pharmaceutical compositions may be formulated with any amphoteric liposome disclosed in WO 2008/043575 to Panzner and U.S. Pat. No. 8,580,297 to Essler et al., the contents of which are incorporated herein by reference in their entirety. The amphoteric liposome may comprise a mixture of lipids including a cationic amphiphile, an anionic amphiphile and optional one or more neutral amphiphiles. The amphoteric liposome may comprise amphoteric compounds based on amphiphilic molecules, the head groups of which being substituted with one or more amphoteric groups. In some embodiments, the pharmaceutical compositions may be formulated with an amphoteric lipid comprising one or more amphoteric groups having an isoelectric point between 4 and 9, as disclosed in US 20140227345 to Essler et al., the contents of which are incorporated herein by reference in their entirety.

The nanoparticle formulations may be a carbohydrate nanoparticle comprising a carbohydrate carrier and a nucleic acid molecule (e.g., saRNA). As a non-limiting example, the carbohydrate carrier may include, but is not limited to, an anhydride-modified phytoglycogen or glycogen-type material, phtoglycogen octenyl succinate, phytoglycogen beta-dextrin, anhydride-modified phytoglycogen beta-dextrin. (See e.g., International Publication No. WO2012109121; the contents of which is herein incorporated by reference in its entirety).

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

In one embodiment, the saRNA may be formulated as a lipoplex, such as, without limitation, the ATUPLEX™ system, the DACC system, the DBTC system and other siRNA-lipoplex technology from Silence Therapeutics (London, United Kingdom), STEMFECT™ from STEMGENT® (Cambridge, Mass.), and polyethylenimine (PEI) or protamine-based targeted and non-targeted delivery of nucleic acids (Aleku et al. Cancer Res. 2008 68:9788-9798; Strumberg et al. Int J Clin Pharmacol Ther 2012 50:76-78; Santel et al., Gene Ther 2006 13:1222-1234; Santel et al., Gene Ther 2006 13:1360-1370; Gutbier et al., Pulm Pharmacol. Ther. 2010 23:334-344; Kaufmann et al. Microvasc Res 2010 80:286-293 Weide et al. J Immunother. 2009 32:498-507; Weide et al. J Immunother. 2008 31:180-188; Pascolo Expert Opin. Biol. Ther. 4:1285-1294; Fotin-Mleczek et al., 2011 J. Immunother. 34:1-15; Song et al., Nature Biotechnol. 2005, 23:709-717; Peer et al., Proc Natl Acad Sci USA. 2007 6; 104:4095-4100; deFougerolles Hum Gene Ther. 2008 19:125-132; the contents of each of which are incorporated herein by reference in its entirety).

In one embodiment such formulations may also be constructed or compositions altered such that they passively or actively are directed to different cell types in vivo, including but not limited to hepatocytes, immune cells, tumor cells, endothelial cells, antigen presenting cells, and leukocytes (Akinc et al. Mol Ther. 2010 18:1357-1364; Song et al., Nat Biotechnol. 2005 23:709-717; Judge et al., J Clin Invest. 2009 119:661-673; Kaufmann et al., Microvasc Res 2010 80:286-293; Santel et al., Gene Ther 2006 13:1222-1234; Santel et al., Gene Ther 2006 13:1360-1370; Gutbier et al., Pulm Pharmacol. Ther. 2010 23:334-344; Basha et al., Mol.

Ther. 2011 19:2186-2200; Fenske and Cullis, Expert Opin Drug Deliv. 2008 5:25-44; Peer et al., Science. 2008 319: 627-630; Peer and Lieberman, Gene Ther. 2011 18:1127-1133; the contents of each of which are incorporated herein by reference in its entirety). One example of passive targeting of formulations to liver cells includes the DLin-DMA, DLin-KC2-DMA and DLin-MC3-DMA-based lipid nanoparticle formulations which have been shown to bind to apolipoprotein E and promote binding and uptake of these formulations into hepatocytes in vivo (Akinc et al. Mol Ther. 2010 18:1357-1364; the contents of which is herein incorporated by reference in its entirety). Formulations can also be selectively targeted through expression of different ligands on their surface as exemplified by, but not limited by, folate, transferrin, N-acetylgalactosamine (GalNAc), and antibody targeted approaches (Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721:339-353; Subramanya et al., Mol Ther. 2010 18:2028-2037; Song et al., Nat Biotechnol. 2005 23:709-717; Peer et al., Science. 2008 319:627-630; Peer and Lieberman, Gene Ther. 2011 18:1127-1133; the contents of each of which are incorporated herein by reference in its entirety).

In one embodiment, the saRNA is formulated as a solid lipid nanoparticle. A solid lipid nanoparticle (SLN) may be spherical with an average diameter between 10 to 1000 nm. SLN possess a solid lipid core matrix that can solubilize lipophilic molecules and may be stabilized with surfactants and/or emulsifiers. In a further embodiment, the lipid nanoparticle may be a self-assembly lipid-polymer nanoparticle (see Zhang et al., ACS Nano, 2008, 2 (8), pp 1696-1702; the contents of which are herein incorporated by reference in its entirety).

In one embodiment, the saRNA of the present invention can be formulated for controlled release and/or targeted delivery. As used herein, "controlled release" refers to a pharmaceutical composition or compound release profile that conforms to a particular pattern of release to effect a therapeutic outcome. In one embodiment, the saRNA may be encapsulated into a delivery agent described herein and/or known in the art for controlled release and/or targeted delivery. As used herein, the term "encapsulate" means to enclose, surround or encase. As it relates to the formulation of the compounds of the invention, encapsulation may be substantial, complete or partial. The term "substantially encapsulated" means that at least greater than 50, 60, 70, 80, 85, 90, 95, 96, 97, 98, 99, 99.9, 99.9 or greater than 99.999% of the pharmaceutical composition or compound of the invention may be enclosed, surrounded or encased within the delivery agent. "Partially encapsulated" means that less than 10, 10, 20, 30, 40 50 or less of the pharmaceutical composition or compound of the invention may be enclosed, surrounded or encased within the delivery agent. Advantageously, encapsulation may be determined by measuring the escape or the activity of the pharmaceutical composition or compound of the invention using fluorescence and/or electron micrograph. For example, at least 1, 5, 10, 20, 30, 40, 50, 60, 70, 80, 85, 90, 95, 96, 97, 98, 99, 99.9, 99.99 or greater than 99.99% of the pharmaceutical composition or compound of the invention are encapsulated in the delivery agent.

In another embodiment, the saRNA may be encapsulated into a lipid nanoparticle or a rapidly eliminated lipid nanoparticle and the lipid nanoparticles or a rapidly eliminated lipid nanoparticle may then be encapsulated into a polymer, hydrogel and/or surgical sealant described herein and/or known in the art. As a non-limiting example, the polymer, hydrogel or surgical sealant may be PLGA, ethylene vinyl acetate (EVAc), poloxamer, GELSITE® (Nanotherapeutics, Inc. Alachua, Fla.), HYLENEX® (Halozyme Therapeutics, San Diego Calif.), surgical sealants such as fibrinogen polymers (Ethicon Inc. Cornelia, Ga.), TISSELL® (Baxter International, Inc Deerfield, Ill.), PEG-based sealants, and COSEAL® (Baxter International, Inc Deerfield, Ill.).

In another embodiment, the lipid nanoparticle may be encapsulated into any polymer known in the art which may form a gel when injected into a subject. As another non-limiting example, the lipid nanoparticle may be encapsulated into a polymer matrix which may be biodegradable.

In one embodiment, the saRNA formulation for controlled release and/or targeted delivery may also include at least one controlled release coating. Controlled release coatings include, but are not limited to, OPADRY®, polyvinylpyrrolidone/vinyl acetate copolymer, polyvinylpyrrolidone, hydroxypropyl methylcellulose, hydroxypropyl cellulose, hydroxyethyl cellulose, EUDRAGIT RL®, EUDRAGIT RS® and cellulose derivatives such as ethylcellulose aqueous dispersions (AQUACOAT® and SURELEASE®).

In one embodiment, the controlled release and/or targeted delivery formulation may comprise at least one degradable polyester which may contain polycationic side chains. Degradeable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In one embodiment, the saRNA of the present invention may be formulated with a targeting lipid with a targeting moiety such as the targeting moieties disclosed in US20130202652 to Manoharan et al., the contents of which are incorporated herein by reference in their entirety. As a non-limiting example, the targeting moiety of formula I of US 20130202652 to Manoharan et al. may selected in order to favor the lipid being localized with a desired organ, tissue, cell, cell type or subtype, or organelle. Non-limiting targeting moieties that are contemplated in the present invention include transferrin, anisamide, an RGD peptide, prostate specific membrane antigen (PSMA), fucose, an antibody, or an aptamer.

In one embodiment, the saRNA of the present invention may be encapsulated in a therapeutic nanoparticle. Therapeutic nanoparticles may be formulated by methods described herein and known in the art such as, but not limited to, International Pub Nos. WO2010005740, WO2010030763, WO2010005721, WO2010005723, WO2012054923, US Pub. Nos. US20110262491, US20100104645, US20100087337, US20100068285, US20110274759, US20100068286 and US20120288541 and U.S. Pat. Nos. 8,206,747, 8,293,276, 8,318,208 and 8,318,211; the contents of each of which are herein incorporated by reference in their entirety. In another embodiment, therapeutic polymer nanoparticles may be identified by the methods described in US Pub No. US20120140790, the contents of which are herein incorporated by reference in its entirety.

In one embodiment, the therapeutic nanoparticle may be formulated for sustained release. As used herein, "sustained release" refers to a pharmaceutical composition or compound that conforms to a release rate over a specific period of time. The period of time may include, but is not limited to, hours, days, weeks, months and years. As a non-limiting example, the sustained release nanoparticle may comprise a polymer and a therapeutic agent such as, but not limited to, the saRNA of the present invention (see International Pub No. 2010075072 and US Pub No. US20100216804, US20110217377 and US20120201859, the contents of each of which are herein incorporated by reference in their entirety).

In one embodiment, the therapeutic nanoparticles may be formulated to be target specific. As a non-limiting example, the therapeutic nanoparticles may include a corticosteroid (see International Pub. No. WO2011084518; the contents of which are herein incorporated by reference in its entirety). In one embodiment, the therapeutic nanoparticles may be formulated to be cancer specific. As a non-limiting example, the therapeutic nanoparticles may be formulated in nanoparticles described in International Pub No. WO2008121949, WO2010005726, WO2010005725, WO2011084521 and US Pub No. US20100069426, US20120004293 and US20100104655, the contents of each of which are herein incorporated by reference in their entirety.

In one embodiment, the nanoparticles of the present invention may comprise a polymeric matrix. As a non-limiting example, the nanoparticle may comprise two or more polymers such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

In one embodiment, the therapeutic nanoparticle comprises a diblock copolymer. In one embodiment, the diblock copolymer may include PEG in combination with a polymer such as, but not limited to, polyethylenes, polycarbonates, polyanhydrides, polyhydroxyacids, polypropylfumerates, polycaprolactones, polyamides, polyacetals, polyethers, polyesters, poly(orthoesters), polycyanoacrylates, polyvinyl alcohols, polyurethanes, polyphosphazenes, polyacrylates, polymethacrylates, polycyanoacrylates, polyureas, polystyrenes, polyamines, polylysine, poly(ethylene imine), poly(serine ester), poly(L-lactide-co-L-lysine), poly(4-hydroxy-L-proline ester) or combinations thereof.

As a non-limiting example the therapeutic nanoparticle comprises a PLGA-PEG block copolymer (see US Pub. No. US20120004293 and U.S. Pat. No. 8,236,330, each of which is herein incorporated by reference in their entirety). In another non-limiting example, the therapeutic nanoparticle is a stealth nanoparticle comprising a diblock copolymer of PEG and PLA or PEG and PLGA (see U.S. Pat. No. 8,246,968 and International Publication No. WO2012166923, the contents of each of which is herein incorporated by reference in its entirety).

In one embodiment, the therapeutic nanoparticle may comprise a multiblock copolymer such as, but not limited to the multiblock copolymers described in U.S. Pat. Nos. 8,263,665 and 8,287,910; the contents of each of which is herein incorporated by reference in its entirety.

In one embodiment, the block copolymers described herein may be included in a polyion complex comprising a non-polymeric micelle and the block copolymer. (See e.g., U.S. Pub. No. 20120076836; the contents of which are herein incorporated by reference in its entirety).

In one embodiment, the therapeutic nanoparticle may comprise at least one acrylic polymer. Acrylic polymers include but are not limited to, acrylic acid, methacrylic acid, acrylic acid and methacrylic acid copolymers, methyl methacrylate copolymers, ethoxyethyl methacrylates, cyanoethyl methacrylate, amino alkyl methacrylate copolymer, poly (acrylic acid), poly(methacrylic acid), polycyanoacrylates and combinations thereof.

In one embodiment, the therapeutic nanoparticles may comprise at least one amine-containing polymer such as, but not limited to polylysine, polyethylene imine, poly(amidoamine) dendrimers, poly(beta-amino esters) (See e.g., U.S. Pat. No. 8,287,849; the contents of which are herein incorporated by reference in its entirety) and combinations thereof.

In one embodiment, the therapeutic nanoparticles may comprise at least one degradable polyester which may contain polycationic side chains. Degradable polyesters include, but are not limited to, poly(serine ester), poly(L-lactide-co-L-lysine), poly(4-hydroxy-L-proline ester), and combinations thereof. In another embodiment, the degradable polyesters may include a PEG conjugation to form a PEGylated polymer.

In another embodiment, the therapeutic nanoparticle may include a conjugation of at least one targeting ligand. The targeting ligand may be any ligand known in the art such as, but not limited to, a monoclonal antibody. (Kirpotin et al, Cancer Res. 2006 66:6732-6740; the contents of which are herein incorporated by reference in its entirety).

In one embodiment, the therapeutic nanoparticle may be formulated in an aqueous solution which may be used to target cancer (see International Pub No. WO2011084513 and US Pub No. US20110294717, the contents of each of which is herein incorporated by reference in their entirety).

In one embodiment, the saRNA may be encapsulated in, linked to and/or associated with synthetic nanocarriers. Synthetic nanocarriers include, but are not limited to, those described in International Pub. Nos. WO2010005740, WO2010030763, WO201213501, WO2012149252, WO2012149255, WO2012149259, WO2012149265, WO2012149268, WO2012149282, WO2012149301, WO2012149393, WO2012149405, WO2012149411, WO2012149454 and WO2013019669, and US Pub. Nos. US20110262491, US20100104645, US20100087337 and US20120244222, the contents of each of which are herein incorporated by reference in their entirety. The synthetic nanocarriers may be formulated using methods known in the art and/or described herein. As a non-limiting example, the synthetic nanocarriers may be formulated by the methods described in International Pub Nos. WO2010005740, WO2010030763 and WO201213501 and US Pub. Nos. US20110262491, US20100104645, US20100087337 and US2012024422, the contents of each of which are herein incorporated by reference in their entirety. In another embodiment, the synthetic nanocarrier formulations may be lyophilized by methods described in International Pub. No. WO2011072218 and U.S. Pat. No. 8,211,473; the contents of each of which are herein incorporated by reference in their entirety.

In one embodiment, the synthetic nanocarriers may contain reactive groups to release the saRNA described herein (see International Pub. No. WO20120952552 and US Pub No. US20120171229, the contents of each of which are herein incorporated by reference in their entirety).

In one embodiment, the synthetic nanocarriers may be formulated for targeted release. In one embodiment, the synthetic nanocarrier may be formulated to release the saRNA at a specified pH and/or after a desired time interval. As a non-limiting example, the synthetic nanoparticle may be formulated to release the saRNA after 24 hours and/or at a pH of 4.5 (see International Pub. Nos. WO2010138193 and WO2010138194 and US Pub Nos. US20110020388 and US20110027217, the contents of each of which is herein incorporated by reference in their entireties).

In one embodiment, the synthetic nanocarriers may be formulated for controlled and/or sustained release of the saRNA described herein. As a non-limiting example, the synthetic nanocarriers for sustained release may be formulated by methods known in the art, described herein and/or as described in International Pub No. WO2010138192 and US Pub No. 20100303850, the contents each of which is herein incorporated by reference in their entirety.

In one embodiment, the nanoparticle may be optimized for oral administration. The nanoparticle may comprise at least one cationic biopolymer such as, but not limited to, chitosan or a derivative thereof. As a non-limiting example, the nanoparticle may be formulated by the methods described in U.S. Pub. No. 20120282343; the contents of which are herein incorporated by reference in its entirety.

In one embodiment, the saRNA of the present invention may be formulated in a modular composition such as described in U.S. Pat. No. 8,575,123 to Manoharan et al., the contents of which are herein incorporated by reference in their entirety. As a non-limiting example, the modular composition may comprise a nucleic acid, e.g., the saRNA of the present invention, at least one endosomolytic component, and at least one targeting ligand. The modular composition may have a formula such as any formula described in U.S. Pat. No. 8,575,123 to Manoharan et al., the contents of which are herein incorporated by reference in their entirety.

In one embodiment, the saRNA of the present invention may be encapsulated in the lipid formulation to form a stable nucleic acid-lipid particle (SNALP) such as described in U.S. Pat. No. 8,546,554 to de Fougerolles et al., the contents of which are incorporated here by reference in their entirety. The lipid may be cationic or non-cationic. In one non-limiting example, the lipid to nucleic acid ratio (mass/mass ratio) (e.g., lipid to saRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1, or 5:1, 6:1, 7:1, 8:1, 9:1, 10:1, or 11:1. In another example, the SNALP includes 40% 2,2-Dilinoleyl-4-dimethylaminoethyl-[1,3]-dioxolane (Lipid A), 10% dioleoylphosphatidylcholine (DSPC), 40% cholesterol, 10% polyethyleneglycol (PEG)-C-DOMG (mole percent) with a particle size of 63.0±20 nm and a 0.027 nucleic acid/lipid ratio. In another embodiment, the saRNA of the present invention may be formulated with a nucleic acid-lipid particle comprising an endosomal membrane destabilizer as disclosed in U.S. Pat. No. 7,189,705 to Lam et al., the contents of which are incorporated herein by reference in their entirety. As a non-limiting example, the endosomal membrane destabilizer may be a $Ca^{2+}$ ion.

In one embodiment, the saRNA of the present invention may be formulated with formulated lipid particles (FLiPs) disclosed in U.S. Pat. No. 8,148,344 to Akine et al., the contents of which are herein incorporated by reference in their entirety. Akine et al. teach that FLiPs may comprise at least one of a single or double stranded oligonucleotide, where the oligonucleotide has been conjugated to a lipophile and at least one of an emulsion or liposome to which the conjugated oligonucleotide has been aggregated, admixed or associated. These particles have surprisingly been shown to effectively deliver oligonucleotides to heart, lung and muscle disclosed in U.S. Pat. No. 8,148,344 to Akine et al., the contents of which are herein incorporated by reference in their entirety.

In one embodiment, the saRNA of the present invention may be delivered to a cell using a composition comprising an expression vector in a lipid formulation as described in U.S. Pat. No. 6,086,913 to Tam et al., the contents of which are incorporated herein by reference in their entirety. The composition disclosed by Tam is serum-stable and comprises an expression vector comprising first and second inverted repeated sequences from an adeno associated virus (AAV), a rep gene from AAV, and a nucleic acid fragment. The expression vector in Tam is complexed with lipids.

In one embodiment, the saRNA of the present invention may be formulated with a lipid formulation disclosed in US 20120270921 to de Fougerolles et al., the contents of which are incorporated herein by reference in their entirety. In one non-limiting example, the lipid formulation may include a cationic lipid having the formula A described in US 20120270921, the contents of which are herein incorporated by reference in its entirety. In another non-limiting example, the compositions of exemplary nucleic acid-lipid particles disclosed in Table A of US 20120270921, the contents of which are incorporated herein by reference in their entirety, may be used with the saRNA of the present invention.

In one embodiment, the saRNA of the present invention may be fully encapsulated in a lipid particle disclosed in US 20120276207 to Maurer et al., the contents of which are incorporated herein by reference in their entirety. The particles may comprise a lipid composition comprising preformed lipid vesicles, a charged therapeutic agent, and a destabilizing agent to form a mixture of preformed vesicles and therapeutic agent in a destabilizing solvent, wherein said destabilizing solvent is effective to destabilize the membrane of the preformed lipid vesicles without disrupting the vesicles.

In one embodiment, the saRNA of the present invention may be formulated with a conjugated lipid. In a non-limiting example, the conjugated lipid may have a formula such as described in US 20120264810 to Lin et al., the contents of which are incorporated herein by reference in their entirety. The conjugate lipid may form a lipid particle which further comprises a cationic lipid, a neutral lipid, and a lipid capable of reducing aggregation.

In one embodiment, the saRNA of the present invention may be formulated in a neutral liposomal formulation such as disclosed in US 20120244207 to Fitzgerald et al., the contents of which are incorporated herein by reference in their entirety. The phrase "neutral liposomal formulation" refers to a liposomal formulation with a near neutral or neutral surface charge at a physiological pH. Physiological pH can be, e.g., about 7.0 to about 7.5, or, e.g., about 7.5, or, e.g., 7.0, 7.1, 7.2, 7.3, 7.4, or 7.5, or, e.g., 7.3, or, e.g., 7.4. An example of a neutral liposomal formulation is an ionizable lipid nanoparticle (iLNP). A neutral liposomal formulation can include an ionizable cationic lipid, e.g., DLin-KC2-DMA.

In one embodiment, the saRNA of the present invention may be formulated with a charged lipid or an amino lipid. As used herein, the term "charged lipid" is meant to include those lipids having one or two fatty acyl or fatty alkyl chains and a quaternary amino head group. The quaternary amine carries a permanent positive charge. The head group can optionally include an ionizable group, such as a primary, secondary, or tertiary amine that may be protonated at physiological pH. The presence of the quaternary amine can alter the pKa of the ionizable group relative to the pKa of the group in a structurally similar compound that lacks the quaternary amine (e.g., the quaternary amine is replaced by a tertiary amine) In some embodiments, a charged lipid is referred to as an "amino lipid." In a non-limiting example, the amino lipid may be amino lipids described in US20110256175 to Hope et al., the contents of which are incorporated herein by reference in their entirety. For example, the amino lipids may have the structure disclosed as structure (II), DLin-K-C2-DMA, DLin-K2-DMA, DLin-K6-DMA disclosed in US20110256175 to Hope et al., the contents of which are incorporated herein by reference in their entirety. In another example, the amino lipid may have the structure (I), (II), (III), or (IV), or 4-(R)-DUn-K-DMA (VI), 4-(S)-DUn-K-DMA (V) as described in WO2009132131 to Muthiah et al., the contents of which are incorporated herein by reference in their entirety. In another example, the charged lipid used in any of the formulations described herein may be any charged lipid described in EP2509636 to Manoharan et al., the contents of which are incorporated herein by reference in their entirety.

In one embodiment, the saRNA of the present invention may be formulated with an association complex containing lipids, liposomes, or lipoplexes. In a non-limiting example, the association complex comprises one or more compounds each having a structure defined by formula (I), a PEG-lipid having a structure defined by formula (XV), a steroid and a nucleic acid disclosed in U.S. Pat. No. 8,034,376 to Manoharan et al., the contents of which are incorporated herein by reference in their entirety. The saRNA may be formulated with any association complex described in U.S. Pat. No. 8,034,376, the contents of which are herein incorporated by reference in its entirety.

In one embodiment, the saRNA of the present invention may be formulated with reverse head group lipids. As a non-limiting example, the saRNA may be formulated with a zwitterionic lipid comprising a headgroup wherein the positive charge is located near the acyl chain region and the negative charge is located at the distal end of the head group, such as a lipid having structure (A) or structure (I) described in WO2011056682 to Leung et al., the contents of which are incorporated herein by reference in their entirety.

In one embodiment, the saRNA of the present invention may be formulated in a lipid bilayer carrier. As a non-limiting example, the saRNA may be combined with a lipid-detergent mixture comprising a lipid mixture of an aggregation-preventing agent in an amount of about 5 mol % to about 20 mol %, a cationic lipid in an amount of about 0.5 mol % to about 50 mol %, and a fusogenic lipid and a detergent, to provide a nucleic acid-lipid-detergent mixture; and then dialyzing said nucleic acid-lipid-detergent mixture against a buffered salt solution to remove said detergent and to encapsulate said nucleic acid in a lipid bilayer carrier and provide a lipid bilayer-nucleic acid composition, wherein said buffered salt solution has an ionic strength sufficient to encapsulate of from about 40% to about 80% of said nucleic acid, described in WO1999018933 to Cullis et al., the contents of which are incorporated herein by reference in their entirety.

In one embodiment, the saRNA of the present invention may be formulated in a nucleic acid-lipid particle capable of selectively targeting the saRNA to a heart, liver, or tumor tissue site. For example, the nucleic acid-lipid particle may comprise (a) a nucleic acid; (b) 1.0 mole % to 45 mole % of a cationic lipid; (c) 0.0 mole % to 90 mole % of another lipid; (d) 1.0 mole % to 10 mole % of a bilayer stabilizing component; (e) 0.0 mole % to 60 mole % cholesterol; and (f) 0.0 mole % to 10 mole % of cationic polymer lipid as described in EP1328254 to Cullis et al., the contents of which are incorporated herein by reference in their entirety. Cullis teaches that varying the amount of each of said cationic lipid, bilayer stabilizing component, another lipid, cholesterol, and cationic polymer lipid can impart tissue selectivity for heart, liver, or tumor tissue site, thereby identifying a nucleic acid-lipid particle capable of selectively targeting a nucleic acid to said heart, liver, or tumor tissue site.

Delivery

The present disclosure encompasses the delivery of saRNA for any of therapeutic, pharmaceutical, diagnostic or imaging by any appropriate route taking into consideration likely advances in the sciences of drug delivery. Delivery may be naked or formulated.

The saRNA of the present invention may be delivered to a cell naked. As used herein in, "naked" refers to delivering saRNA free from agents which promote transfection. For example, the saRNA delivered to the cell may contain no modifications. The naked saRNA may be delivered to the cell using routes of administration known in the art and described herein.

The saRNA of the present invention may be formulated, using the methods described herein. The formulations may contain saRNA which may be modified and/or unmodified. The formulations may further include, but are not limited to, cell penetration agents, a pharmaceutically acceptable carrier, a delivery agent, a bioerodible or biocompatible polymer, a solvent, and a sustained-release delivery depot. The formulated saRNA may be delivered to the cell using routes of administration known in the art and described herein.

The compositions may also be formulated for direct delivery to an organ or tissue in any of several ways in the art including, but not limited to, direct soaking or bathing, via a catheter, by gels, powder, ointments, creams, gels, lotions, and/or drops, by using substrates such as fabric or biodegradable materials coated or impregnated with the compositions, and the like. The saRNA of the present invention may also be cloned into a retroviral replicating vector (RRV) and transduced to cells.

Administration

The saRNA of the present invention may be administered by any route which results in a therapeutically effective outcome. These include, but are not limited to, enteral, gastroenteral, epidural, oral, transdermal, epidural (peridural), intracerebral (into the cerebrum), intracerebroventricular (into the cerebral ventricles), epicutaneous (application onto the skin), intradermal, (into the skin itself), subcutaneous (under the skin), nasal administration (through the nose), intravenous (into a vein), intraarterial (into an artery), intramuscular (into a muscle), intracardiac (into the heart), intraosseous infusion (into the bone marrow), intrathecal (into the spinal canal), intraperitoneal, (infusion or injection into the peritoneum), intravesical infusion, intravitreal, (through the eye), intracavernous injection, (into the base of the penis), intravaginal administration, intrauterine, extra-amniotic administration, transdermal (diffusion through the intact skin for systemic distribution), transmucosal (diffusion through a mucous membrane), insufflation (snorting), sublingual, sublabial, enema, eye drops (onto the conjunctiva), or in ear drops. In specific embodiments, compositions may be administered in a way which allows them cross the blood-brain barrier, vascular barrier, or other epithelial barrier. Routes of administration disclosed in International Publication WO 2013/090648 filed Dec. 14, 2012, the contents of which are incorporated herein by reference in their entirety, may be used to administer the saRNA of the present invention.

Dosage Forms

A pharmaceutical composition described herein can be formulated into a dosage form described herein, such as a topical, intranasal, intratracheal, or injectable (e.g., intravenous, intraocular, intravitreal, intramuscular, intracardiac, intraperitoneal, subcutaneous). Liquid dosage forms, injectable preparations, pulmonary forms, and solid dosage forms described in International Publication WO 2013/090648 filed Dec. 14, 2012, the contents of which are incorporated herein by reference in their entirety may be used as dosage forms for the saRNA of the present invention.

II. Methods of use

One aspect of the present invention provides methods of using C/EBPα-saRNA and pharmaceutical compositions comprising said C/EBPα-saRNA and at least one pharmaceutically acceptable carrier. C/EBPα-saRNA modulates C/EBPα gene expression. In one embodiment, the expression of C/EBPα gene is increased by at least 20, 30, 40%, more preferably at least 45, 50, 55, 60, 65, 70, 75%, even more preferably at least 80% in the presence of the saRNA of the present invention compared to the expression of C/EBPα gene in the absence of the saRNA of the present invention. In a further preferable embodiment, the expression of C/EBPα gene is increased by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100, in the presence of the saRNA of the present invention compared to the expression of C/EBPα gene in the absence of the saRNA of the present invention.

Metabolics Regulation

Hepatocytes are generally perceived as being important for maintenance of several vital functions. For example, they can regulate carbohydrate and lipid metabolism and detoxification of exogenous and endogenous compounds. C/EBPα is expressed in a variety of tissues where it plays an important role in the differentiation of many cell types including adipocytes, type II alveolar cells and hepatocytes. In the mouse, C/EBPα is found most abundantly in fat, liver and lung tissues. The function role of C/EBPα includes, but not limited to, regulation of alpha-1-antitrypsin, transthyretin and albumin. Furthermore, expression of C/EBPα gene in the liver cell line (HepG2) results in increased levels of cytochrome P450 (CYP), a superfamily of monooxygenases that participates in the metabolism of endogenous substrates and plays a key role in detoxification and metabolic activation of key xenobiotics [Jover et al., *FEBS Letters*, vol. 431(2), 227-230 (1998), the contents of which are incorporated herein by reference in their entirety].

Non-alcoholic fatty liver disease (NAFLD) is a major global health concern and affects 1 in 3 people in the United States. NAFLD is the build-up of extra fat (lipid) in liver cells that is not caused by excessive alcohol use. It is called a fatty liver (steatosis) if more than 5%-10% of the liver's weight is fat. NAFLD may progress to steatoheptitis, cirrhosis, and liver cancer. It is associated with metabolic disorders, such as metabolic syndrome, insulin resistance, type II diabetes, hyperlipidemia, hypertension, obesity, etc. Treatment methods include lowering low-density lipoprotein (LDL) cholesterol levels, improving insulin sensitivity, treating metabolic risk factors, weight loss and so on. [Adams et al., *Postgraduate Medical Journal*, vol. 82, 315-322 (2006); Musso et al., *Curr. Opin. Lipidol.*, vol. 22(6), 489-496 (2011), the contents of which are incorporated herein by reference in their entirety]

Figure 2:
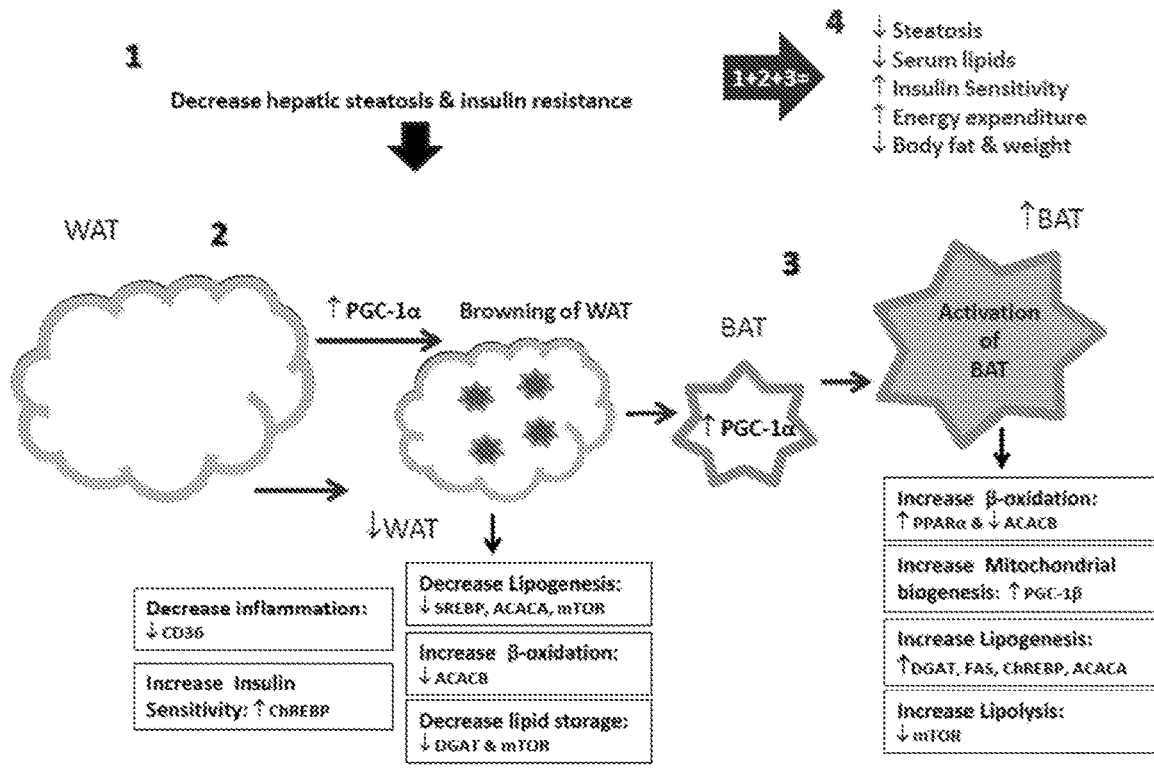
FIG. 2 shows the secondary effects of C/EBPα on the adipose tissue.

C/EBPα protein plays an important role in regulating liver function and metabolics. The primary effects of C/EBPα on the liver are shown in FIG. 1, including decreasing fatty acid uptake by lowering CD36 protein level, decreasing de novo lipogenesis by lowering sterol regulatory element-binding proteins (SREBP), carbohydrate-responsive element-binding protein (ChREBP) and fatty acid synthase (FAS) protein levels, increasing β-oxidation by increasing peroxisome proliferator-activated receptor alpha (PPARα) and peroxisome proliferator-activated receptor gamma coactivator 1-alpha &-beta (PGC-1α & β) protein levels, decreasing hepatic lipid overload by lowering apolipoprotein C-III (APOC3) and low density lipoprotein receptor (LDLR) protein levels, decreasing progression to fibrosis by increasing PGC-1β protein level, and decreasing insulin resistance by increasing peroxisome proliferator-activated receptor gamma (PPARγ) protein level. Furthermore, C/EBPα has secondary effects on adipose tissues as shown in FIG. 2. White adipose tissue (WAT) is not only a lipogenic and fat storage tissue but also an important endocrine organ that regulates energy homeostasis, lipid metabolism, appetite, fertility, and immune and stress responses. Brown adipose tissue (BAT) contains numerous smaller lipid droplets and a much higher number of iron-containing mitochondria compared with WAT. It plays a significant role in nutritional energetics, energy balance and body weight. There is evidence that the atrophy of BAT is related to obesity. In particular, studies have indicated that impaired thermogenesis in BAT is important in the aetiology of obesity in rodents [Trayhurn P., *J. Biosci.*, vol. 18(2), 161-173 (1993)]. C/EBPα decreases hepatic steatosis and insulin resistance and increases PGC-1α protein level, which may in turn cause browning of WAT, turn WAT into BAT, and then activate BAT, thereby reducing body fat and weight. Therefore, C/EBPα-saRNA of the present invention may be used to regulate liver function, reduce steatosis, reduce serum lipids, treat NAFLD, treat insulin resistance, increase energy expenditure, and treat obesity.

In one embodiment, provided is a method of regulating liver metabolism genes in vitro and in vivo by treatment of C/EBPα-saRNA of the present invention. Also provided is a method of regulating liver genes involved in NAFLD in vitro and in vivo by treatment of C/EBPα-saRNA of the present invention. The genes include, but are not limited to sterol regulatory element-binding factor 1 (SREBF-1 or SREBF), cluster of differentiation 36 (CD36), acetyl-CoA carboxylase 2 (ACACB), apolipoprotein C-III (APOC3), microsomal triglyceride transfer protein (MTP), peroxisome proliferator-activated receptor gamma coactivator 1 alpha (PPARγ-CoA1α or PPARGC1A), low density lipoprotein receptor (LDLR), peroxisome proliferator-activated receptor gamma coactivator 1 beta (PPARγ-CoA1β or PERC), peroxisome proliferator-activated receptor gamma (PPARγ), acetyl-CoA carboxylase 1 (ACACA), carbohydrate-responsive element-binding protein (ChREBP or MLX1PL), peroxisome proliferator-activated receptor alpha (PPARα or PPARA), FASN (fatty acid synthase), diglyceride acyltransferase-2 (DGAT2), and mammalian target of rapamycin (mTOR). In one embodiment, C/EBPα-saRNA decreases the expression of SREBF-1 gene in liver cells by at least 20%, 30%, preferably at least 40%. In one embodiment, C/EBPα-saRNA decreases the expression of CD36 gene in liver cells by at least 20%, 30%, 40%, 50%, preferably at least 75%, 90%. In one embodiment, C/EBPα-saRNA increases the expression of ACACB gene in liver cells by at least 20%, 30%, 40%, 50%, preferably at least 75%, 90%, 100%, 125%, 150%. In one embodiment, C/EBPα-saRNA decreases the expression of APOC3 gene in liver cells by at least 20%, 30%, 40%, 50%, preferably at least 75%, 90%. In one embodiment, C/EBPα-saRNA decreases the expression of MTP gene in liver cells by at least 20%, 30%, 40%, 50%, preferably at least 75%, 90%. In one embodiment, C/EBPα-saRNA increases the expression of PPARγ-CoA1α gene in liver cells by at least 20%, 30%, 40%, 50%, preferably at least 75%, 90%, 100%, 125%, 150%, more preferably at least 175%, 200%, 250%, 300%. In one embodiment, C/EBPα-saRNA increases the expression of PPARγ gene in liver cells by at least 20%, 30%, 40%, 50%, preferably at least 75%, 90%, 100%, 125%, 150%, more preferably at least 175%, 200%, 250%, 300%. In one embodiment, C/EBPα-saRNA increases the expression of PPARα gene in liver cells by at least 20%, 30%, 40%, 50%, preferably at least 75%, 90%, 100%, 125%, 150%, more preferably at least 175%, 200%, 250%, 300%. In one embodiment, C/EBPα-saRNA decreases the expression of MLXIPL gene in liver cells by at least 20%, 30%, 40%, 50%, preferably at least 75%. In one embodiment, C/EBPα-saRNA decreases the expression of FASN gene in liver cells by at least 20%, 30%, 40%, 50%, preferably at least 75%, 90%. In one embodiment, C/EBPα-saRNA decreases the expression of DGAT2 gene in liver cells by at least 10%, 20%, preferably at least 30%, 40%, 50%.

C/EBPα-saRNA also modulates the expression of liver metabolism genes disclosed above in BAT cells. In another embodiment, C/EBPα-saRNA decreases the expression of SREBP gene in BAT cells by at least 20%, 30%, preferably at least 40%. In one embodiment, C/EBPα-saRNA decreases the expression of CD36 gene in BAT cells by at least 20%, 30%, 40%, 50%, preferably at least 75%, 90%. In one embodiment, C/EBPα-saRNA decreases the expression of LDLR gene in BAT cells by at least 20%, 30%, 40%, 50%, preferably at least 75%, 90%. In one embodiment, C/EBPα-saRNA increases the expression of PPARGC1A gene in BAT cells by at least 20%, 30%, preferably at least 40%. In one embodiment, C/EBPα-saRNA decreases the expression of APOC gene in BAT cells by at least 20%, 30%, 40%, 50%, preferably at least 75%, 90%, more preferably at least 95%, 99%. In one embodiment, C/EBPα-saRNA decreases the expression of ACACB gene in BAT cells by at least 20%, 30%, 40%, 50%, preferably at least 75%. In one embodiment, C/EBPα-saRNA decreases the expression of PERC gene in BAT cells by at least 20%, 30%, 40%, 50%, preferably at least 75%. In one embodiment, C/EBPα-saRNA increases the expression of ACACA gene in BAT cells by at least 20%, 30%, 40%, 50%, preferably at least 75%, 90%, 100%, 125%, 150%. In one embodiment, C/EBPα-saRNA decreases the expression of MLXP1 gene in BAT cells by at least 20%, 30%, 40%, preferably at least 50%. In one embodiment, C/EBPα-saRNA decreases the expression of MTOR gene in BAT cells by at least 20%, 30%, 40%, preferably at least 50%, 75%. In one embodiment, C/EBPα-saRNA increases the expression of PPARA gene in BAT cells by at least 20%, 30%, 40%, 50%, preferably at least 75%, 90%, 100%, 125%, 150%, more preferably at least 200%, 250%, 300%, 350%, 400%. In one embodiment, C/EBPα-saRNA increases the expression of FASN gene in BAT cells by at least 20%, 30%, 40%, 50%, preferably at least 75%, 90%. In one embodiment, C/EBPα-saRNA increases the expression of DGAT gene in BAT cells by at least 20%, 30%, 40%, 50%, preferably at least 75%, 90%, 100%, 125%, 150%, more preferably at least 200%, 250%, 300%.

C/EBPα-saRNA also modulates the expression of liver metabolism genes disclosed above in WAT cells. In another embodiment, C/EBPα-saRNA decreases the expression of SREBP gene in WAT cells by at least 20%, 30%, preferably at least 40%. In one embodiment, C/EBPα-saRNA decreases the expression of CD36 gene in WAT cells by at least 20%, 30%, 40%, 50%, preferably at least 75%, 90%. In one embodiment, C/EBPα-saRNA decreases the expression of LDLR gene in WAT cells by at least 20%, 30%, 40%, 50%, preferably at least 75%, 90%. In one embodiment, C/EBPα-saRNA increases the expression of PPARGC1A gene in WAT cells by at least 20%, 30%, preferably at least 40%. In one embodiment, C/EBPα-saRNA increases the expression of MTP gene in WAT cells by at least 20%, 30%, 40%, 50%, preferably at least 75%, 90%, more preferably at least 95%, more preferably at least by a factor of 1.5, 2.0, 2.5, 3.0, 3.5, 4.0, more preferably by at least a factor of 5.0, 6.0, 7.0, 8.0, 9.0, 10.0. In one embodiment, In one embodiment, C/EBPα-saRNA increases the expression of APOC gene in WAT cells by at least 20%, 30%, 40%, 50%, preferably at least 75%, 90%, more preferably at least 95%, 99%. In one embodiment, C/EBPα-saRNA decreases the expression of ACACB gene in WAT cells by at least 20%, 30%, 40%, 50%, preferably at least 75%. In one embodiment, C/EBPα-saRNA decreases the expression of PERC gene in WAT cells by at least 20%, 30%, 40%, 50%, preferably at least 75%. In one embodiment, C/EBPα-saRNA decreases the expression of ACACA gene in WAT cells by at least 20%, 30%, 40%, 50%, preferably at least 75%, 90%, 95%. In one embodiment, C/EBPα-saRNA decreases the expression of MLX1PL gene in WAT cells by at least 20%, 30%, 40%, preferably at least 50%. In one embodiment, C/EBPα-saRNA decreases the expression of MTOR gene in WAT cells by at least 20%, 30%, 40%, preferably at least 50%, 75%. In one embodiment, C/EBPα-saRNA decreases the expression of FASN gene in WAT cells by at least 5%, 10%, preferably at least 15%, 20%. In one embodiment, C/EBPα-saRNA decreases the expression of DGAT gene in WAT cells by at least 10%, 20%, 30%, more preferably 40%, 50%.

In another embodiment, provided is a method of reducing insulin resistance (IR) or increasing insulin sensitivity by administering C/EBPα-saRNA of the present invention to a patient in need thereof. Also provided is a method of treating type II diabetes, hyperinsulinaemia and steatosis by administering C/EBPα-saRNA of the present invention to a patient in need thereof. If liver cells are resistance to insulin and cannot use insulin effectively, hyperglycemia develops. Subsequently, beta cells in pancreas increase their production of insulin leading to hyperinsulinemia and type II diabetes. Many regulators affect insulin resistance of liver cells. For example, sterol regulatory element-binding proteins 1 (SREBP1 or SREBP) is the master regulator of cholesterol and associated with increased insulin resistance. The up-regulation of cholesteryl ester transfer protein (CETP) is associated with increased insulin resistance. The up-regulation of hepatic fatty acid translocase/cluster of differentiation 36 (FAT/CD36) is associated with insulin resistance, hyperinsulinaemia, increased steatosis in patients with non-alcoholic steatohepatitis (NASH). Liver-specific overexpression of lipoprotein lipase gene (LPL) causes liver-specific insulin resistance. Liver X receptor gene (LXR) has a central role in insulin-mediated activation of sterol regulatory element-binding protein (SREBP)-1c-induced fatty acid synthesis in liver. Other factors include diglyceride acyltransferase-2 (DGAT2) that regulates triglyceride synthesis and fatty acid synthase (FASN) that regulates fatty acid biosynthesis. In one embodiment, C/EBPα-saRNA reduces the expression of FAT/CD36 gene in liver cells by at least 25%, preferably at least 50%, more preferably at least 75%, even more preferably 90% compared to liver cells with no treatment. In another embodiment, C/EBPα-saRNA increases the expression of LPL gene in liver cells by at least 20, 30, 40%, preferably at least 45, 50, 55, 60, 65, 70, 75, 80, 85, 90, 95%, more preferably at least 100, 150, 200, 250, 300, 350 and 400% compared to liver cells with no treatment. In another embodiment, C/EBPα-saRNA increases the expression of LXR gene in liver cells by at least 45, 50, 55, 60, 65, 70, 75, 80, 85, 90, 95%, more preferably at least 100, 150, 200, 250, 300, 350 and 400%, even more preferably at least 450, 500, 550, 600% compared to liver cells with no treatment. In another embodiment, C/EBPα-saRNA decreases SREBP1 gene expression. In another embodiment, C/EBPα-saRNA decreases DGAT2 gene expression. In another embodiment, C/EBPα-saRNA decreases CETP gene expression. In yet another embodiment, C/EBPα-saRNA decreases FASN gene expression.

A summary of NAFLD and IR genes that may be modulated with C/EBPα-saRNA is shown in Table 4. Abbreviations in Table 4: NAFLD: non-alcoholic fatty liver disease; IR: insulin resistance; DNL: de novo lipogenesis; FA: fatty acid; TG: triglycerides; LPL: lipoprotein lipase; HP: hepatic lipase; CHOL: cholesterol.

TABLE 4

NAFLD and IR genes that may be modulated with C/EBPα-saRNA

| Gene name | Mechanism | Function/encoded products - References | Deregulation in NAFLD | Deregulation in IR |
|---|---|---|---|---|
| CD36 | FAs uptake | Scavenger receptor, free FAs transporter in liver and adipose tissue; regulates adipose tissue apoptosis and inflammation | up | up |
| PPARγ | DNL | Activates genes involved in lipid storage and metabolism; required for lipid homeostasis; high expressed in adipose tissue and very low in the liver; implicated in adipocyte differentiation and insulin sensitivity | up | down |
| PPARγ-CoA 1β (PERC) | DNL | Transcriptional coactivator for SREBP-1; enhances lipogenesis and VLDL synthesis; highly expressed in brown fat and heart and induced in the liver during fasting; master regulator of mitochondrial biogenesis and oxidative metabolism, lipogenesis, and TG secretion | up | up |
| SREBP-1c | DNL | Transcription factor, induces genes involved in glucose utilization and FA synthesis; major mediator of insulin action on lipogenic genes; regulates adipogenesis | up | up |
| ChREBP (MLX1PL) | DNL | Transcription factors activated by glucose; induces glycolytic and lipogenic genes; major determinant of adipose tissue fatty acid synthesis and systemic insulin sensitivity | up | up |
| FAS | DNL | Enzyme that catalyzes the last step in FA biosynthesis | up | up |
| ACACA (ACC1) | DNL | Enzyme that catalyzes the synthesis of malonyl-CoA for the synthesis of FAs in the cytosol | up | up |
| ACACB (ACC2) | β-oxidation | Enzyme that catalyzes the synthesis of malonyl-CoA, which functions as inhibitor of mitochondrial β-oxidation | up | up |
| PPARα | β-oxidation | Activates the genes involved in the oxidation of FAs, major regulator of lipid metabolism in the liver; predominantly expressed in the liver; involved in the regulation of glucose homeostasis, insulin sensitivity, fat accumulation, and adipose tissue glucose use | down | down |
| PPARγ-CoA 1α | β-oxidation | Transcriptional co-activator that regulates mitochondrial biology and energy homeostasis; crucial role in mitochondrial biogenesis; interacts with PPARα to increase the mitochondrial β-oxidation of FAs | down | down |
| DGAT2 | TG synthesis | Enzyme that catalyzes the final reaction in the synthesis of TG | up | up |
| APOC3 | TG concentration | Protein that inhibits LPL and HP; involved in the regulation of plasma TG concentrations; pro-steatosic | up | up |

TABLE 4-continued

NAFLD and IR genes that may be modulated with C/EBPα-saRNA

| | | | | |
|---|---|---|---|---|
| LDLR | CHOL concentration | Low-density lipoprotein receptor; critical role in regulating blood CHOL levels; abundant in the liver, which is the organ responsible for removing most excess CHOL from the body | down | no change |
| MTP (MTTP1) | Lipoprotein assembly | Carrier of TG; central role in VLDL assembly; prevalently expressed in the liver | down | no change |
| mTOR | Adipose mass | Possible regulator of adipose tissue mass; central role in lipolysis, lipogenesis, and adipogenesis | up | up |

| | Effects of Ezetimibe | Effects of C/EBPα | | |
|---|---|---|---|---|
| Gene name | in the liver | Liver | WAT | BAT |
| CD36 | minor down | down | down | down |
| PPARγ | up | up | no change | no change |
| PPARγ-CoA 1β (PERC) | up | up | down | up |
| SREBP-1c | up | down | down | down |
| ChREBP (MLX1PL) | up | down | up | up |
| FAS | down | down | minor up | up |
| ACACA (ACC1) | minor up | no change | down | up |
| ACACB (ACC2) | up | up | down | down |
| PPARα | up | up | down | up |
| PPARγ-CoA 1α | up | up | up | up |
| DGAT2 | minor down | minor down | down | up |
| APOC3 | down | down | up | down |
| LDLR | minor down | down | up | minor down |
| MTP (MTTP1) | up | down | up | down |
| mTOR | no change | no change | down | down |

In one embodiment of the present invention, provided is a method of lowering serum cholesterol level in vitro by treatment of C/EBPα-saRNA of the present invention. The serum cholesterol level with C/EBPα-saRNA reduces at least 25%, preferably 50%, more preferably 75% compared to serum cholesterol level with no treatment. Also provided is a method of lowering LDL and triglyceride levels in hepatocyte cells and increasing circulating levels of LDL in vivo by administering C/EBPα-saRNA of the present invention. The circulation LDL level may increase at least by a factor of 2, preferably by a factor of 3, preferably by a factor of 4, preferably by a factor of 5, preferably by a factor of 10, and preferably by a factor of 15 compared to circulating LDL level in the absence of C/EBPα-saRNA. The liver triglyceride level may be reduced by at least 10%, 20%, 30%, 40%, 50%, 60%, or 70% compared to the liver triglyceride level in the absence of C/EBPα-saRNA. The liver LDL level may be reduced by at least 10%, 20%, 30%, 40%, 50%, 60%, or 70% compared to the liver LDL level in the absence of C/EBPα-saRNA.

In one embodiment of the present invention, provided is a method of treating NAFLD and reducing fatty liver size by administering C/EBPα-saRNA of the present invention to a patient in need thereof. The size of a fatty liver of a patient treated with C/EBPα-saRNA is reduced by at least 10%, 20%, 30%, 40%, or 50% compared with a patient without treatment. Also provided is a method of reducing body weight and treating obesity by administering C/EBPα-saRNA of the present invention to a patient in need thereof. The body weight of a patient treated with C/EBPα-saRNA is lower than the body weight of a patient without treatment of C/EBPα-saRNA by at least 10%, 20%, 30%, 40%, 50%, 60%, or 70%. C/EBPα-saRNA of the present invention may be administered in a dose, 2 doses, 3 does or more. Also provided is a method of decreasing hepatic uptake of free fatty acids by treatment of C/EBPα-saRNA of the present invention. Also provided is a method of reducing white adipose tissue (WAT) inflammation by treatment of C/EBPα-saRNA of the present invention. Also provided is a method of reducing de novo lipogenesis by treatment of C/EBPα-saRNA of the present invention. Also provided is a method of increasing beta-oxidation in the liver by treatment of C/EBPα-saRNA of the present invention. Also provided is a method of increasing brown adipose tissue (BAT) in the liver by treatment of C/EBPα-saRNA of the present invention. Also provided is a method of reducing hepatic lipid uptake by treatment of C/EBPα-saRNA of the present invention. Also provided is a method of decreasing lipogenesis in WAT by treatment of C/EBPα-saRNA of the present invention. Also provided is a method of decreasing lipid storage in liver by treatment of C/EBPα-saRNA of the present invention. Also provided is a method of reducing lipid overload in the liver by treatment of C/EBPα-saRNA of the present invention.

In another embodiment, C/EBPα-saRNA of the present invention is used to increase liver function. In one non-limiting example, C/EBPα-saRNA increases albumin gene expression and thereby increasing serum albumin and unconjugated bilirubin levels. The expression of albumin gene may be increased by at least 20, 30, 40%, more preferably at least 45, 50, 55, 60, 65, 70, 75%, even more preferably at least 80% in the presence of the saRNA of the present invention compared to the expression of albumin gene in the absence of the saRNA of the present invention. In a further preferable embodiment, the expression of albumin gene is increased by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100, in the presence of the saRNA of the present invention compared to the expression of albumin gene in the absence of the saRNA of the present invention. In another non-limiting example, C/EBPα-saRNA decreases the amount of alanine transaminase (ALT), aspartate aminotransferase (AST), gamma glutamyl transpeptidase (GGT), alphafectoprotein (AFP) and hepatocyte growth factor (HGF). The amount of ALT, AST, GGT, AFP, or HGF may be decreased by at least 20, 30, 40%, more preferably at least 45, 50, 55, 60, 65, 70, 75%, even more preferably at least 80% in the presence of the saRNA of the present invention compared to the amount of any of ALT, AST, GGT, AFP, or HGF in the absence of the saRNA of the present invention.

In another embodiment, C/EBPα-saRNA of the present invention is administered to regulate the levels of other members of the C/EBP family. C/EBPα-saRNA increases the expression of C/EBPβ, C/EBPγ, C/EBPδ and C/EBPζ depending on the dose of C/EBPα-saRNA. In yet another embodiment, the ratio of C/EBPα or C/EBPβ protein isoforms in a cell is regulated by contacting said cell with C/EBPα-saRNA of the present invention. In one embodiment, the 42 KDa isoform of C/EBPα is increased. In one embodiment, the 30 kDa isoform of C/EBPβ is increased.

ecCEBPA

Extra coding CEBPA (ecCEBPA), a functional ncRNA transcribed from the CEBPA locus, regulates CEBPA methylation by interacting with DNA methyltransferase (DNMT1) thus preventing CEBPA gene methylation. It has been found that ecCEBPA knockdown led to a decrease of CEBPA mRNA expression and to a significant increase in DNA methylation (Ruscio et al., Nature, vol. 503:371-376 (2013), the contents of which are incorporated herein by reference in their entirety). In another embodiment, C/EBPα-saRNA of the present invention is used to upregulate ecCEBPA levels.

Surgical Care

Hepatectomy, surgical resection of the liver or hepatic tissue might cause liver failure, reduced production of albumin and coagulation factors. Proper surgical care after hepatectomy is needed. In some embodiments, C/EBPα-saRNA of the present invention is used for surgical care after hepatectomy to promote liver regeneration and increase survival rate.

Hyperproliferation Disorders

In one embodiment of the invention, C/EBPα-saRNA of the present invention is used to reduce cell proliferation of hyperproliferative cells. Examples of hyperproliferative cells include cancerous cells, e.g., carcinomas, sarcomas, lymphomas and blastomas. Such cancerous cells may be benign or malignant. Hyperproliferative cells may result from an autoimmune condition such as rheumatoid arthritis, inflammatory bowel disease, or psoriasis. Hyperproliferative cells may also result within patients with an oversensitive immune system coming into contact with an allergen. Such conditions involving an oversensitive immune system include, but are not limited to, asthma, allergic rhinitis, eczema, and allergic reactions, such as allergic anaphylaxis. In one embodiment, tumor cell development and/or growth is inhibited. In a preferred embodiment, solid tumor cell proliferation is inhibited. In another preferred embodiment, metastasis of tumor cells is prevented. In another preferred example, undifferentiated tumor cell proliferation is inhibited.

Inhibition of cell proliferation or reducing proliferation means that proliferation is reduced or stops altogether. Thus, "reducing proliferation" is an embodiment of "inhibiting proliferation". Proliferation of a cell is reduced by at least 20%, 30% or 40%, or preferably at least 45, 50, 55, 60, 65, 70 or 75%, even more preferably at least 80, 90 or 95% in the presence of the saRNA of the invention compared to the proliferation of said cell prior to treatment with the saRNA of the invention, or compared to the proliferation of an equivalent untreated cell. In embodiments wherein cell proliferation is inhibited in hyperproliferative cells, the "equivalent" cell is also a hyperproliferative cell. In preferred embodiments, proliferation is reduced to a rate comparable to the proliferative rate of the equivalent healthy (non-hyperproliferative) cell. Alternatively viewed, a preferred embodiment of "inhibiting cell proliferation" is the inhibition of hyperproliferation or modulating cell proliferation to reach a normal, healthy level of proliferation.

In one non-limiting example, C/EBPα-saRNA is used to reduce the proliferation of leukemia and lymphoma cells. Preferably, the cells include Jurkat cells (acute T cell lymphoma cell line), K562 cells (erythroleukemia cell line), U373 cells (glioblastoma cell line), and 32Dp210 cells (myeloid leukemia cell line).

In another non-limiting example, C/EBPα-saRNA is used to reduce the proliferation of ovarian cancer cells, liver cancer cells, pancreatic cancer cells, breast cancer cells, prostate cancer cells, rat liver cancer cells, and insulinoma cells. Preferably, the cells include PEO1 and PEO4 (ovarian cancer cell line), HepG2 (hepatocellular carcinoma cell line), Panc1 (human pancreatic carcinoma cell line), MCF7 (human breast adenocarcinoma cell line), DU145 (human metastatic prostate cancer cell line), rat liver cancer cells, and MIN6 (rat insulinoma cell line).

In another non-limiting example, C/EBPα-saRNA is used in combination with a siRNA targeting C/EBPβ gene to reduce tumor cell proliferation. Tumor cell may include hepatocellular carcinoma cells such as HepG2 cells and breast cancer cells such as MCF7 cells.

In one embodiment, the saRNA of the present invention is used to treat hyperproliferative disorders. Tumors and cancers represent a hyperproliferative disorder of particular interest, and all types of tumors and cancers, e.g. solid tumors and haematological cancers are included. Examples of cancer include, but not limited to, cervical cancer, uterine cancer, ovarian cancer, kidney cancer, gallbladder cancer, liver cancer, head and neck cancer, squamous cell carcinoma, gastrointestinal cancer, breast cancer, prostate cancer, testicular cancer, lung cancer, non-small cell lung cancer, non-Hodgkin's lymphoma, multiple myeloma, leukemia (such as acute lymphocytic leukemia, chronic lymphocytic leukemia, acute myelogenous leukemia, and chronic myelogenous leukemia), brain cancer (e.g. astrocytoma, glioblastoma, medulloblastoma), neuroblastoma, sarcomas, colon cancer, rectum cancer, stomach cancer, anal cancer, bladder cancer, endometrial cancer, plasmacytoma, lymphomas, retinoblastoma, Wilm's tumor, Ewing sarcoma, melanoma and other skin cancers. The liver cancer may include, but not limited to, cholangiocarcinoma, hepatoblastoma, haemangiosarcoma, or hepatocellular carcinoma (HCC). HCC is of particular interest.

Primary liver cancer is the fifth most frequent cancer worldwide and the third most common cause of cancer-related mortality. HCC represents the vast majority of primary liver cancers [El-Serag et al., *Gastroenterology*, vol. 132(7), 2557-2576 (2007), the contents of which are disclosed herein in their entirety]. HCC is influenced by the interaction of several factors involving cancer cell biology, immune system, and different aetiologies (viral, toxic and generic). The majority of patients with HCC develop malignant tumors from a background of liver cirrhosis. Currently most patients are diagnosed at an advanced stage and therefore the 5 year survival for the majority of HCC patients remains dismal. Surgical resection, loco-regional ablation and liver transplantation are currently the only therapeutic options which have the potential to cure HCC. However, based on the evaluation of individual liver function and tumor burden only about 5-15% of patients are eligible for surgical intervention. The binding sites for the family of C/EBP transcription factors are present in the promoter regions of numerous genes that are involved in the maintenance of normal hepatocyte function and response to injury (including albumin, interleukin 6 response, energy homeostasis, ornithine cycle regulation and serum amyloid A expression). The present invention utilizes C/EBPα-saRNA to modulate the expression of C/EBPα gene and treat liver cirrhosis and HCC.

The method of the present invention may reduce tumor volume by at least 10, 20, 30, 40, 50, 60, 70, 80 or 90%. Preferably, the development of one or more new tumors is inhibited, e.g. a subject treated according to the invention develops fewer and/or smaller tumors. Fewer tumors means that he develops a smaller number of tumors than an equivalent subject over a set period of time. For example, he develops at least 1, 2, 3, 4 or 5 fewer tumors than an equivalent control (untreated) subject. Smaller tumor means that the tumors are at least 10, 20, 30, 40, 50, 60, 70, 80 or 90% smaller in weight and/or volume than tumors of an equivalent subject. The method of the present invention reduces tumor burden by at least 10, 20, 30, 40, 50, 60, 70, 80 or 90%.

The set period of time may be any suitable period, e.g. 1, 2, 3, 4, 5, 6, 7, 8, 9 or 10 months or years.

In one non-limiting example, provided is a method of treating an undifferentiated tumor, comprising contacting a cell, tissue, organ or subject with C/EBPα-saRNA of the present invention. Undifferentiated tumors generally have a poorer prognosis compared to differentiated ones. As the degree of differentiation in tumors has a bearing on prognosis, it is hypothesized that the use of a differentiating biological agent could be a beneficial anti-proliferative drug. C/EBPα is known to restore myeloid differentiation and prevent hyperproliferation of hematopoietic cells in acute myeloid leukemia. Preferably, undifferentiated tumors that may be treated with C/EBPα-saRNA include undifferentiated small cell lung carcinomas, undifferentiated pancreatic adenocarcinomas, undifferentiated human pancreatic carcinoma, undifferentiated human metastatic prostate cancer, and undifferentiated human breast cancer.

In one non-limiting example, C/EBPα-saRNA is complexed into PAMAM dendrimer, referred to as C/EBPα-saRNA-dendrimer for targeted in vivo delivery. The therapeutic effect of intravenously injected C/EBPα-saRNA-dendrimers is demonstrated in a clinically relevant rat liver tumor model as shown in Example 1. After three doses through tail vein injection at 48 hour intervals, the treated cirrhotic rats showed significantly increased serum albumin levels within one week. The liver tumor burden was significantly decreased in the C/EBPα-saRNA dendrimer treated groups. This study demonstrates, for the first time, that gene targeting by small activating RNA molecules can be used by systemic intravenous administration to simultaneously ameliorate liver function and reduce tumor burden in cirrhotic rats with HCC.

In one embodiment, C/EBPα-saRNA is used to regulate oncogenes and tumor suppressor genes. Preferably, the expression of the oncogenes may be down-regulated. The expression of the oncogenes reduces by at least 20, 30, 40%, more preferably at least 45, 50, 55, 60, 65, 70, 75, 80, 85, 90, 95% in the presence of C/EBPα-saRNA of the invention compared to the expression in the absence of C/EBPα-saRNA of the invention. In a further preferable embodiment, the expression of the oncogenes is reduced by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100, in the presence of C/EBPα-saRNA of the invention compared to the expression in the absence of C/EBPα-saRNA of the invention. Preferably, the expressions of tumor suppressor genes may be inhibited. The expression of the tumor suppressor genes increase by at least 20, 30, 40%, more preferably at least 45, 50, 55, 60, 65, 70, 75, 80, 85, 90, 95%, even more preferably at least 100% in the presence of C/EBPα-saRNA of the invention compared to the expression in the absence of C/EBPα-saRNA of the invention. In a further preferable embodiment, the expression of tumor suppressor genes is increased by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100 in the presence of C/EBPα-saRNA of the invention compared to the expression in the absence of C/EBPα-saRNA of the invention. Non-limiting examples of oncogenes and tumor suppressor genes include Bcl-2-associated X protein (BAX), BH3 interacting domain death agonist (BID), caspase 8 (CASP8), disabled homolog 2-interacting protein (DAB21P), deleted in liver cancer 1 (DLC1), Fas surface death receptor (FAS), fragile histidine triad (FHIT), growth arrest and DNA-damage-inducible-beta (GADD45B), hedgehog interacting protein (HHIP), insulin-like growth factor 2 (IGF2), lymphoid enhancer-binding factor 1 (LEF1), phosphatase and tensin homolog (PTEN), protein tyrosine kinase 2 (PTK2), retinoblastoma 1 (RB 1), runt-related transcription factor 3 (RUNX3), SMAD family member 4 (SMAD4), suppressor of cytokine signaling (3 SOCS3), transforming growth factor, beta receptor II (TGFBR2), tumor necrosis factor (ligand) superfamily, member 10 (TNFSF10), P53, disintegrin and metalloproteinase domain-containing protein 17 (ADAM17), v-akt murine thymoma viral oncogene homolog 1 (AKT1), angiopoietin 2 (ANGPT2), B-cell CLL/lymphoma 2 (BCL2), BCL2-like 1 (BCL2L1), baculoviral IAP repeat containing 2 (BIRC2), baculoviral IAP repeat containing 5 (BIRC5), chemokine (C—C motif) ligand 5 (CCL5), cyclin D1 (CCND1), cyclin D2 (CCND2), cadherin 1 (CDH1), cadherin 13 (CDH13), cyclin-dependent kinase inhibitor 1A (CDKN1A), cyclin-dependent kinase inhibitor 1B (CDKN1B), cyclin-dependent kinase inhibitor 2A (CDKN2A), CASP8 and FADD-like apoptosis regulator (CFLAR), catenin (cadherin-associated protein) beta 1 (CTNNB1), chemokine receptor 4 (CXCR4), E2F transcription factor 1 (E2F1), epidermal growth factor (EGF), epidermal growth factor receptor (EGFR), E1A binding protein p300 (EP300), Fas (TNFRSF6)-associated via death domain (FADD), fms-related tyrosine kinase 1 (FLT1), frizzled family receptor 7 (FZD7), glutathione S-transferase pi 1 (GSTP1), hepatocyte growth factor (HGF), Harvey rat sarcoma viral oncogene homolog (HRAS), insulin-like growth factor binding protein 1 (IGFBP1), insulin-like growth factor binding protein 3 (IGFBP3), insulin receptor substrate 1 (IRS1), integrin beta 1 (ITGB1), kinase insert domain receptor (KDR), myeloid cell leukemia sequence 1 (MCL1), met proto-oncogene (MET), mutS homolog 2 (MSH2), mutS homolog 3 (MSH3), metadherin (MTDH), v-myc avian myelocytomatosis viral oncogene homolog (MYC), nuclear factor of kappa light polypeptide gene enhancer in B-cells 1 (NFKB1), neuroblastoma RAS viral (v-ras) oncogene homolog (NRAS), opioid binding protein/cell adhesion molecule-like (OPCML), platelet-derived growth factor receptor, alpha polypeptide (PDGFRA), peptidylprolyl cis/trans isomerase, NIMA-interacting 1 (PIN1), prostaglandin-endoperoxide synthase 2 (PTGS2), PYD and CARD domain containing (PYCARD), ras-related C3 botulinum toxin substrate 1 (RAC1), Ras association (RalGDS/AF-6) domain family member 1 (RASSF1), reelin (RELN), ras homolog family member A (RHOA), secreted frizzled-related protein 2 (SFRP2), SMAD family member 7 (SMAD7), suppressor of cytokine signaling 1 (SOCS1), signal transducer and activator of transcription 3 (STAT3), transcription factor 4 (TCF4), telomerase reverse transcriptase (TERT), transforming growth factor alpha (TGFA), transforming growth factor beta 1 (TGFB1), toll-like receptor 4 (TLR4), tumor necrosis factor receptor superfamily member 10b (TNFRSF10B), vascular endothelial growth factor A (VEGFA), Wilms tumor 1 (WT1), X-linked inhibitor of apoptosis (XIAP), and Yes-associated protein 1 (YAP1).

In one embodiment, provided is a method of increasing white blood cell count by administering C/EBPα-saRNA of the present invention to a patient in need thereof. Also provided is a method of treating leukopaenia for patients having sepsis or chronic inflammation diseases (e.g., hepatitis and liver cirrhosis) and for immunocompromised patients (e.g., patients undergoing chemotherapy) by administering C/EBPα-saRNA of the present invention to said patient. Also provided is a method of treating pre B cell and B cell malignancies including leukaemia and lymphoma by administering C/EBPα-saRNA of the present invention to a patient in need thereof. Also provided is a method of mobilize white blood cells, haematopoietic or mesenchymal stem cells by administering C/EBPα-saRNA of the present invention to a patient in need thereof. In one embodiment, the white blood cell count in a patient treated with C/EBPα-saRNA is increased by at least 50%, 75%, 100%, more preferably by at least a factor of 1.5, 2, 2.5, 3, 3.5, 4, 4.5, 5, more preferably by at least a factor of 6, 7, 8, 9, 10 compared to no C/EBPα-saRNA treatment.

In one embodiment, C/EBPα-saRNA is used to regulate micro RNAs (miRNA or miR) in the treatment of hepatocellular carcinoma. MicroRNAs are small non-coding RNAs that regulate gene expression. They are implicated in important physiological functions and they may be involved in every single step of carcinogenesis. They typically have 21 nucleotides and regulate gene expression at the post transcriptional level via blockage of mRNA translation or induction of mRNA degradation by binding to the 3'-untranslated regions (3'-UTR) of said mRNA.

In tumors, regulation of miRNA expression affects tumor development. In HCC, as in other cancers, miRNAs function either as oncogenes or tumor suppressor genes influencing cell growth and proliferation, cell metabolism and differentiation, apoptosis, angiogenesis, metastasis and eventually prognosis. [Lin et al., *Biochemical and Biophysical Research Communications*, vol. 375, 315-320 (2008); Kutay et al., *J. Cell. Biochem.*, vol. 99, 671-678 (2006); Meng et al., *Gastroenterology*, vol. 133(2), 647-658 (2007), the contents of each of which are incorporated herein by reference in their entirety] C/EBPα-saRNA of the present invention modulates C/EBPα gene expression and/or function and also regulates miRNA levels in HCC cells. Non-limiting examples of miRNAs that may be regulated by C/EBPα-saRNA of the present invention include hsa-let-7a-5p, hsa-miR-133b, hsa-miR-122-5p, hsa-miR-335-5p, hsa-miR-196a-5p, hsa-miR-142-5p, hsa-miR-96-5p, hsa-miR-184, hsa-miR-214-3p, hsa-miR-15a-5p, hsa-let-7b-5p, hsa-miR-205-5p, hsa-miR-181a-5p, hsa-miR-140-5p, hsa-miR-146b-5p, hsa-miR-34c-5p, hsa-miR-134, hsa-let-7g-5p, hsa-let-7c, hsa-miR-218-5p, hsa-miR-206, hsa-miR-124-3p, hsa-miR-100-5p, hsa-miR-10b-5p, hsa-miR-155-5p, hsa-miR-1, hsa-miR-150-5p, hsa-let-7i-5p, hsa-miR-27b-3p, hsa-miR-127-5p, hsa-miR-191-5p, hsa-let-7f-5p, hsa-miR-10a-5p, hsa-miR-15b-5p, hsa-miR-16-5p, hsa-miR-34a-5p, hsa-miR-144-3p, hsa-miR-128, hsa-miR-215, hsa-miR-193a-5p, hsa-miR-23b-3p, hsa-miR-203a, hsa-miR-30c-5p, hsa-let-7e-5p, hsa-miR-146a-5p, hsa-let-7d-5p, hsa-miR-9-5p, hsa-miR-181b-5p, hsa-miR-181c-5p, hsa-miR-20b-5p, hsa-miR-125a-5p, hsa-miR-148b-3p, hsa-miR-92a-3p, hsa-miR-378a-3p, hsa-miR-130a-3p, hsa-miR-20a-5p, hsa-miR-132-3p, hsa-miR-193b-3p, hsa-miR-183-5p, hsa-miR-148a-3p, hsa-miR-138-5p, hsa-miR-373-3p, hsa-miR-29b-3p, hsa-miR-135b-5p, hsa-miR-21-5p, hsa-miR-181d, hsa-miR-301a-3p, hsa-miR-200c-3p, hsa-miR-7-5p, hsa-miR-29a-3p, hsa-miR-210, hsa-miR-17-5p, hsa-miR-98-5p, hsa-miR-25-3p, hsa-miR-143-3p, hsa-miR-19a-3p, hsa-miR-18a-5p, hsa-miR-125b-5p, hsa-miR-126-3p, hsa-miR-27a-3p, hsa-miR-372, hsa-miR-149-5p, and hsa-miR-32-5p.

In one non-limiting example, the miRNAs are oncogenic miRNAs and are downregulated by a factor of at least 0.01, 0.02, 0.05, 0.1, 0.2, 0.3, 0.5, 1, 1.5, 2, 2.5, and 3, in the presence of C/EBPα-saRNA of the invention compared to in the absence of C/EBPα-saRNA. In another non-limiting example, the miRNAs are tumor suppressing miRNAs and are upregulated by a factor of at least 0.01, 0.02, 0.05, 0.1, 0.2, 0.3, 0.5, 1, more preferably by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100, in the presence of C/EBPα-saRNA of the invention compared to in the absence of C/EBPα-saRNA.

Stem Cell Regulation

In some embodiments of the present invention, C/EBPα-saRNA is used to regulate self-renewal pluripotency factors and affect stem cell differentiation. Altering the phenotype of cells in order to express a protein of interest or to change a cell to a different cell phenotype has been used in different clinical, therapeutic and research settings. Altering a phenotype of a cell is currently accomplished by expressing protein from DNA or viral vectors. Currently there are studies being done to evaluate the use of human embryonic stem cells as a treatment option for various diseases such as Parkinson's disease and diabetes and injuries such as a spinal cord injury. Embryonic stem cells have the ability to grow indefinitely while maintaining Pluripotency to generate any differentiated cell type.

Many factors such as pluripotency factors, cell phenotype altering factors, transdifferentiation factors, differentiation factors and dedifferentiation factors, are utilized to alter cell phenotype, which is useful in the field of personal regenerative medicine, cell therapy and therapies for other diseases. For example, the self-renewal and pluripotency properties of stem cells are regulated by an array of genes, such as transcription factors and chromatin remodeling enzymes, in a core regulatory circuitry including OCT4, SOX2, NANOG, and KLF genes [Bourillot et al., *BMC Biology*, 8:125 (2010), the contents of which are incorporated herein by reference in their entirety]. This regulatory circuitry for self-regulatory networks also affects downstream genes. Oligonucleotides have been utilized to regulate the core regulatory circuitry. Xu et al. disclosed that miRNA-145 targets the 3'-UTR of OCT4, SOX2, and KLF4. Reducing miRNA-145 impairs differentiation and elevates OCT4, SOX2, and KLF4. [Xu et al., Cell, vol. 137, 1-12 (2009), the contents of which are incorporated herein by reference in their entirety]

In one embodiment, C/EBPα-saRNA of the present invention is used to regulate self-renewal pluripotency genes. Non-limiting examples of pluripotency genes include SOX2, OCT4, cKit, KLF4, KLF2, KLF5, NANOG, CDX2, and SALL4. In one embodiment, the expression of the pluripotency gene is reduced by at least 20%, 30% or 40%, or preferably at least 45, 50, 55, 60, 65, 70 or 75%, even more preferably at least 80, 90 or 95%, in the presence of C/EBPα-saRNA of the invention compared to in the absence of C/EBPα-saRNA. In another embodiment, the expression of the pluripotency gene is increased by at least 20, 30, 40%, more preferably at least 45, 50, 55, 60, 65, 70, 75%, even more preferably at least 80%, in the presence of C/EBPα-saRNA of the invention compared to in the absence of C/EBPα-saRNA. In a preferable embodiment, the expression of the pluripotency gene is increased by a factor of at least 2, 3, 4, 5, 6, 7, 8, 9, 10, more preferably by a factor of at least 15, 20, 25, 30, 35, 40, 45, 50, even more preferably by a factor of at least 60, 70, 80, 90, 100, in the presence of C/EBPα-saRNA of the invention compared to the expression in the absence of C/EBPα-saRNA.

In one embodiment, C/EBPα-saRNA is used to regulate epithelial-mesenchymal transition (EMT) of a cell. Some tumors contain cancer stem cells or cancer stem-like cells that can self-renew and maintain tumor-initiating capacity through differentiation into a different lineage of cancer cells. It has been demonstrated that EMT is associated with cancer stem-like cells, tumor aggressiveness and metastasis, and tumor recurrence. [Kong et al., Cancers, vol. 3(1), 716-729 (2011)] There are many factors that regulate EMT, including miRNAs such as miR-200 and miR-134, growth factors such as fibroblast growth factor (FGF), epidermal growth factor (EGF), platelet-derived growth factor (PDGF), as well as factors such as Notch-1 and Wnt signaling pathway. In one non-limiting example, C/EBPα-saRNA regulates EMT by modulating the expression of miR-134. In another non-limiting example, C/EBPα-saRNA regulates EMT by modulating the expression of RUNX3, CTNB1, HGF, SMAD7 or TGFB1 genes.

III. Kits and Devices
Kits

The invention provides a variety of kits for conveniently and/or effectively carrying out methods of the present invention. Typically kits will comprise sufficient amounts and/or numbers of components to allow a user to perform multiple treatments of a subject(s) and/or to perform multiple experiments.

In one embodiment, the present invention provides kits for regulate the expression of genes in vitro or in vivo, comprising C/EBPα-saRNA of the present invention or a combination of C/EBPα-saRNA, saRNA modulating other genes, siRNAs, or miRNAs. The kit may further comprise packaging and instructions and/or a delivery agent to form a formulation composition. The delivery agent may comprise a saline, a buffered solution, a lipidoid, a dendrimer or any delivery agent disclosed herein. Non-limiting examples of genes include C/EBPα, other members of C/EBP family, albumin gene, alphafectoprotein gene, liver specific factor genes, growth factors, nuclear factor genes, tumor suppressing genes, pluripotency factor genes.

In one non-limiting example, the buffer solution may include sodium chloride, calcium chloride, phosphate and/or EDTA. In another non-limiting example, the buffer solution may include, but is not limited to, saline, saline with 2 mM calcium, 5% sucrose, 5% sucrose with 2 mM calcium, 5% Mannitol, 5% Mannitol with 2 mM calcium, Ringer's lactate, sodium chloride, sodium chloride with 2 mM calcium and mannose (See U.S. Pub. No. 20120258046; herein incorporated by reference in its entirety). In yet another non-limiting example, the buffer solutions may be precipitated or it may be lyophilized. The amount of each component may be varied to enable consistent, reproducible higher concentration saline or simple buffer formulations. The components may also be varied in order to increase the stability of saRNA in the buffer solution over a period of time and/or under a variety of conditions.

In another embodiment, the present invention provides kits to regulate the proliferation of cells, comprising C/EBPα-saRNA of the present invention, provided in an amount effective to inhibit the proliferation of cells when introduced into said cells; optionally siRNAs and miRNAs to further regulate the proliferation of target cells; and packaging and instructions and/or a delivery agent to form a formulation composition.

In another embodiment, the present invention provides kits for reducing LDL levels in cells, comprising saRNA molecules of the present invention; optionally LDL reducing drugs; and packaging and instructions and/or a delivery agent to form a formulation composition.

In another embodiment, the present invention provides kits for regulating miRNA expression levels in cells, comprising C/EBPα-saRNA of the present invention; optionally siRNAs, eRNAs and lncRNAs; and packaging and instructions and/or a delivery agent to form a formulation composition.

Devices

The present invention provides for devices which may incorporate C/EBPα-saRNA of the present invention. These devices contain in a stable formulation available to be immediately delivered to a subject in need thereof, such as a human patient. Non-limiting examples of such a subject include a subject with hyperproliferative disorders such as cancer, tumor, or liver cirrhosis; and metabolics disorders such as NAFLD, obesity, high LDL cholesterol, or type II diabetes.

Non-limiting examples of the devices include a pump, a catheter, a needle, a transdermal patch, a pressurized olfactory delivery device, iontophoresis devices, multi-layered microfluidic devices. The devices may be employed to deliver C/EBPα-saRNA of the present invention according to single, multi- or split-dosing regimens. The devices may be employed to deliver C/EBPα-saRNA of the present invention across biological tissue, intradermal, subcutaneously, or intramuscularly. More examples of devices suitable for delivering oligonucleotides are disclosed in International Publication WO 2013/090648 filed Dec. 14, 2012, the contents of which are incorporated herein by reference in their entirety.

Definitions

For convenience, the meaning of certain terms and phrases used in the specification, examples, and appended claims, are provided below. If there is an apparent discrepancy between the usage of a term in other parts of this specification and its definition provided in this section, the definition in this section shall prevail.

About: As used herein, the term "about" means+/−10% of the recited value.

Administered in combination: As used herein, the term "administered in combination" or "combined administration" means that two or more agents, e.g., saRNA, are administered to a subject at the same time or within an interval such that there may be an overlap of an effect of each agent on the patient. In some embodiments, they are administered within about 60, 30, 15, 10, 5, or 1 minute of one another. In some embodiments, the administrations of the agents are spaced sufficiently close together such that a combinatorial (e.g., a synergistic) effect is achieved.

Amino acid: As used herein, the terms "amino acid" and "amino acids" refer to all naturally occurring L-alpha-amino acids. The amino acids are identified by either the one-letter or three-letter designations as follows: aspartic acid (Asp: D), isoleucine threonine (Thr:T), leucine (Leu:L), serine (Ser:S), tyrosine (Tyr:Y), glutamic acid (Glu:E), phenylalanine (Phe:F), proline (Pro:P), histidine (His:H), glycine (Gly:G), lysine (Lys:K), alanine (Ala:A), arginine (Arg:R), cysteine (Cys:C), tryptophan (Trp:W), valine (Val:V), glutamine (Gln:Q) methionine (Met:M), asparagines (Asn:N), where the amino acid is listed first followed parenthetically by the three and one letter codes, respectively.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically-engineered animal, or a clone.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Associated with: As used herein, the terms "associated with," "conjugated," "linked," "attached," and "tethered," when used with respect to two or more moieties, means that the moieties are physically associated or connected with one another, either directly or via one or more additional moieties that serves as a linking agent, to form a structure that is sufficiently stable so that the moieties remain physically associated under the conditions in which the structure is used, e.g., physiological conditions. An "association" need not be strictly through direct covalent chemical bonding. It may also suggest ionic or hydrogen bonding or a hybridization based connectivity sufficiently stable such that the "associated" entities remain physically associated.

Bifunctional: As used herein, the term "bifunctional" refers to any substance, molecule or moiety which is capable of or maintains at least two functions. The functions may affect the same outcome or a different outcome. The structure that produces the function may be the same or different.

Biocompatible: As used herein, the term "biocompatible" means compatible with living cells, tissues, organs or systems posing little to no risk of injury, toxicity or rejection by the immune system.

Biodegradable: As used herein, the term "biodegradable" means capable of being broken down into innocuous products by the action of living things.

Biologically active: As used herein, the phrase "biologically active" refers to a characteristic of any substance that has activity in a biological system and/or organism. For instance, a substance that, when administered to an organism, has a biological effect on that organism, is considered to be biologically active. In particular embodiments, the saRNA of the present invention may be considered biologically active if even a portion of the saRNA is biologically active or mimics an activity considered biologically relevant.

Cancer: As used herein, the term "cancer" in an individual refers to the presence of cells possessing characteristics typical of cancer-causing cells, such as uncontrolled proliferation, immortality, metastatic potential, rapid growth and proliferation rate, and certain characteristic morphological features. Often, cancer cells will be in the form of a tumor, but such cells may exist alone within an individual, or may circulate in the blood stream as independent cells, such as leukemic cells.

Cell growth: As used herein, the term "cell growth" is principally associated with growth in cell numbers, which occurs by means of cell reproduction (i.e. proliferation) when the rate of the latter is greater than the rate of cell death (e.g. by apoptosis or necrosis), to produce an increase in the size of a population of cells, although a small component of that growth may in certain circumstances be due also to an increase in cell size or cytoplasmic volume of individual cells. An agent that inhibits cell growth can thus do so by either inhibiting proliferation or stimulating cell death, or both, such that the equilibrium between these two opposing processes is altered.

Cell type: As used herein, the term "cell type" refers to a cell from a given source (e.g., a tissue, organ) or a cell in a given state of differentiation, or a cell associated with a given pathology or genetic makeup.

Chromosome: As used herein, the term "chromosome" refers to an organized structure of DNA and protein found in cells.

Complementary: As used herein, the term "complementary" as it relates to nucleic acids refers to hybridization or base pairing between nucleotides or nucleic acids, such as, for example, between the two strands of a double-stranded DNA molecule or between an oligonucleotide probe and a target are complementary.

Condition: As used herein, the term "condition" refers to the status of any cell, organ, organ system or organism. Conditions may reflect a disease state or simply the physiologic presentation or situation of an entity. Conditions may be characterized as phenotypic conditions such as the macroscopic presentation of a disease or genotypic conditions such as the underlying gene or protein expression profiles associated with the condition. Conditions may be benign or malignant.

Controlled Release: As used herein, the term "controlled release" refers to a pharmaceutical composition or compound release profile that conforms to a particular pattern of release to effect a therapeutic outcome.

Cytostatic: As used herein, "cytostatic" refers to inhibiting, reducing, suppressing the growth, division, or multiplication of a cell (e.g., a mammalian cell (e.g., a human cell)), bacterium, virus, fungus, protozoan, parasite, prion, or a combination thereof.

Cytotoxic: As used herein, "cytotoxic" refers to killing or causing injurious, toxic, or deadly effect on a cell (e.g., a mammalian cell (e.g., a human cell)), bacterium, virus, fungus, protozoan, parasite, prion, or a combination thereof.

Delivery: As used herein, "delivery" refers to the act or manner of delivering a compound, substance, entity, moiety, cargo or payload.

Delivery Agent: As used herein, "delivery agent" refers to any substance which facilitates, at least in part, the in vivo delivery of a saRNA of the present invention to targeted cells.

Destabilized: As used herein, the term "destable," "destabilize," or "destabilizing region" means a region or molecule that is less stable than a starting, wild-type or native form of the same region or molecule.

Detectable label: As used herein, "detectable label" refers to one or more markers, signals, or moieties which are attached, incorporated or associated with another entity that is readily detected by methods known in the art including radiography, fluorescence, chemiluminescence, enzymatic activity, absorbance and the like. Detectable labels include radioisotopes, fluorophores, chromophores, enzymes, dyes, metal ions, ligands such as biotin, avidin, streptavidin and haptens, quantum dots, and the like. Detectable labels may be located at any position in the peptides, proteins or polynucleotides, e.g, saRNA, disclosed herein. They may be within the amino acids, the peptides, proteins, or polynucleotides located at the N- or C-termini or 5' or 3' termini as the case may be.

Encapsulate: As used herein, the term "encapsulate" means to enclose, surround or encase.

Engineered: As used herein, embodiments of the invention are "engineered" when they are designed to have a feature or property, whether structural or chemical, that varies from a starting point, wild type or native molecule.

Equivalent subject: As used herein, "equivalent subject" may be e.g. a subject of similar age, sex and health such as liver health or cancer stage, or the same subject prior to treatment according to the invention. The equivalent subject is "untreated" in that he does not receive treatment with an saRNA according to the invention. However, he may receive a conventional anti-cancer treatment, provided that the subject who is treated with the saRNA of the invention receives the same or equivalent conventional anti-cancer treatment.

Exosome: As used herein, "exosome" is a vesicle secreted by mammalian cells.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Feature: As used herein, a "feature" refers to a characteristic, a property, or a distinctive element.

Formulation: As used herein, a "formulation" includes at least an saRNA of the present invention and a delivery agent.

Fragment: A "fragment," as used herein, refers to a portion. For example, fragments of proteins may comprise polypeptides obtained by digesting full-length protein isolated from cultured cells.

Functional: As used herein, a "functional" biological molecule is a biological molecule in a form in which it exhibits a property and/or activity by which it is characterized.

Gene: As used herein, the term "gene" refers to a nucleic acid sequence that comprises control and most often coding sequences necessary for producing a polypeptide or precursor. Genes, however, may not be translated and instead code for regulatory or structural RNA molecules.

A gene may be derived in whole or in part from any source known to the art, including a plant, a fungus, an animal, a bacterial genome or episome, eukaryotic, nuclear or plasmid DNA, cDNA, viral DNA, or chemically synthesized DNA. A gene may contain one or more modifications in either the coding or the untranslated regions that could affect the biological activity or the chemical structure of the expression product, the rate of expression, or the manner of expression control. Such modifications include, but are not limited to, mutations, insertions, deletions, and substitutions of one or more nucleotides. The gene may constitute an uninterrupted coding sequence or it may include one or more introns, bound by the appropriate splice junctions.

Gene expression: As used herein, the term "gene expression" refers to the process by which a nucleic acid sequence undergoes successful transcription and in most instances translation to produce a protein or peptide. For clarity, when reference is made to measurement of "gene expression", this should be understood to mean that measurements may be of the nucleic acid product of transcription, e.g., RNA or mRNA or of the amino acid product of translation, e.g., polypeptides or peptides. Methods of measuring the amount or levels of RNA, mRNA, polypeptides and peptides are well known in the art.

Genome: The term "genome" is intended to include the entire DNA complement of an organism, including the nuclear DNA component, chromosomal or extrachromosomal DNA, as well as the cytoplasmic domain (e.g., mitochondrial DNA).

Homology: As used herein, the term "homology" refers to the overall relatedness between polymeric molecules, e.g. between nucleic acid molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the invention, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the invention, two protein sequences are considered to be homologous if the proteins are at least about 50%, 60%, 70%, 80%, or 90% identical for at least one stretch of at least about 20 amino acids.

The term "hyperproliferative cell" may refer to any cell that is proliferating at a rate that is abnormally high in comparison to the proliferating rate of an equivalent healthy cell (which may be referred to as a "control"). An "equivalent healthy" cell is the normal, healthy counterpart of a cell. Thus, it is a cell of the same type, e.g. from the same organ, which performs the same functions(s) as the comparator cell. For example, proliferation of a hyperproliferative hepatocyte should be assessed by reference to a healthy hepatocyte, whereas proliferation of a hyperproliferative prostate cell should be assessed by reference to a healthy prostate cell.

By an "abnormally high" rate of proliferation, it is meant that the rate of proliferation of the hyperproliferative cells is increased by at least 20, 30, 40%, or at least 45, 50, 55, 60, 65, 70, 75%, or at least 80%, as compared to the proliferative rate of equivalent, healthy (non-hyperproliferative) cells. The "abnormally high" rate of proliferation may also refer to a rate that is increased by a factor of at least 2, 3, 4, 5, 6, 7, 8, 9, 10, or by a factor of at least 15, 20, 25, 30, 35, 40, 45, 50, or by a factor of at least 60, 70, 80, 90, 100, compared to the proliferative rate of equivalent, healthy cells.

The term "hyperproliferative cell" as used herein does not refer to a cell which naturally proliferates at a higher rate as compared to most cells, but is a healthy cell. Examples of cells that are known to divide constantly throughout life are skin cells, cells of the gastrointestinal tract, blood cells and bone marrow cells. However, when such cells proliferate at a higher rate than their healthy counterparts, then they are hyperproliferative.

Hyperproliferative disorder: As used herein, a "hyperproliferative disorder" may be any disorder which involves hyperproliferative cells as defined above. Examples of hyperproliferative disorders include neoplastic disorders such as cancer, psoriatic arthritis, rheumatoid arthritis, gastric hyperproliferative disorders such as inflammatory bowel disease, skin disorders including psoriasis, Reiter's syndrome, pityriasis rubra pilaris, and hyperproliferative variants of the disorders of keratinization.

The skilled person is fully aware of how to identify a hyperproliferative cell. The presence of hyperproliferative cells within an animal may be identifiable using scans such as X-rays, MRI or CT scans. The hyperproliferative cell may also be identified, or the proliferation of cells may be assayed, through the culturing of a sample in vitro using cell proliferation assays, such as MTT, XTT, MTS or WST-1 assays. Cell proliferation in vitro can also be determined using flow cytometry.

Identity: As used herein, the term "identity" refers to the overall relatedness between polymeric molecules, e.g., between oligonucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; each of which is incorporated herein by reference. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research,* 12(1), 387 (1984)), BLASTP, BLASTN, and FASTA Altschul, S. F. et al., *J. Molec. Biol.,* 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically a reduction in the level of an mRNA results in a reduction in the level of a polypeptide translated therefrom. The level of expression may be determined using standard techniques for measuring mRNA or protein.

In vitro: As used herein, the term "in vitro" refers to events that occur in an artificial environment, e.g., in a test tube or reaction vessel, in cell culture, in a Petri dish, etc., rather than within an organism (e.g., animal, plant, or microbe).

In vivo: As used herein, the term "in vivo" refers to events that occur within an organism (e.g., animal, plant, or microbe or cell or tissue thereof).

Isolated: As used herein, the term "isolated" refers to a substance or entity that has been separated from at least some of the components with which it was associated (whether in nature or in an experimental setting). Isolated substances may have varying levels of purity in reference to the substances from which they have been associated. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components. Substantially isolated: By "substantially isolated" is meant that the compound is substantially separated from the environment in which it was formed or detected. Partial separation can include, for example, a composition enriched in the compound of the present disclosure. Substantial separation can include compositions containing at least about 50%, at least about 60%, at least about 70%, at least about 80%, at least about 90%, at least about 95%, at least about 97%, or at least about 99% by weight of the compound of the present disclosure, or salt thereof. Methods for isolating compounds and their salts are routine in the art.

Label: The term "label" refers to a substance or a compound which is incorporated into an object so that the substance, compound or object may be detectable.

Linker: As used herein, a linker refers to a group of atoms, e.g., 10-1,000 atoms, and can be comprised of the atoms or groups such as, but not limited to, carbon, amino, alkylamino, oxygen, sulfur, sulfoxide, sulfonyl, carbonyl, and imine. The linker can be attached to a modified nucleoside or nucleotide on the nucleobase or sugar moiety at a first end, and to a payload, e.g., a detectable or therapeutic agent, at a second end. The linker may be of sufficient length as to not interfere with incorporation into a nucleic acid sequence. The linker can be used for any useful purpose, such as to form saRNA conjugates, as well as to administer a payload, as described herein. Examples of chemical groups that can be incorporated into the linker include, but are not limited to, alkyl, alkenyl, alkynyl, amido, amino, ether, thioether, ester, alkylene, heteroalkylene, aryl, or heterocyclyl, each of which can be optionally substituted, as described herein. Examples of linkers include, but are not limited to, unsaturated alkanes, polyethylene glycols (e.g., ethylene or propylene glycol monomeric units, e.g., diethylene glycol, dipropylene glycol, triethylene glycol, tripropylene glycol, tetraethylene glycol, or tetraethylene glycol), and dextran polymers and derivatives thereof. Other examples include, but are not limited to, cleavable moieties within the linker, such as, for example, a disulfide bond (—S—S—) or an azo bond (—N═N—), which can be cleaved using a reducing agent or photolysis. Non-limiting examples of a selectively cleavable bond include an amido bond can be cleaved for example by the use of tris(2-carboxyethyl)phosphine (TCEP), or other reducing agents, and/or photolysis, as well as an ester bond can be cleaved for example by acidic or basic hydrolysis.

Metastasis: As used herein, the term "metastasis" means the process by which cancer spreads from the place at which it first arose as a primary tumor to distant locations in the body. Metastasis also refers to cancers resulting from the spread of the primary tumor. For example, someone with breast cancer may show metastases in their lymph system, liver, bones or lungs.

Modified: As used herein "modified" refers to a changed state or structure of a molecule of the invention. Molecules may be modified in many ways including chemically, structurally, and functionally. In one embodiment, the saRNA molecules of the present invention are modified by the introduction of non-natural nucleosides and/or nucleotides.

Naturally occurring: As used herein, "naturally occurring" means existing in nature without artificial aid.

Nucleic acid: The term "nucleic acid" as used herein, refers to a molecule comprised of one or more nucleotides, i.e., ribonucleotides, deoxyribonucleotides, or both. The term includes monomers and polymers of ribonucleotides and deoxyribonucleotides, with the ribonucleotides and/or deoxyribonucleotides being bound together, in the case of the polymers, via 5' to 3' linkages. The ribonucleotide and deoxyribonucleotide polymers may be single or double-stranded. However, linkages may include any of the linkages known in the art including, for example, nucleic acids comprising 5' to 3' linkages. The nucleotides may be naturally occurring or may be synthetically produced analogs that are capable of forming base-pair relationships with naturally occurring base pairs. Examples of non-naturally occurring bases that are capable of forming base-pairing relationships include, but are not limited to, aza and deaza pyrimidine analogs, aza and deaza purine analogs, and other heterocyclic base analogs, wherein one or more of the carbon and nitrogen atoms of the pyrimidine rings have been substituted by heteroatoms, e.g., oxygen, sulfur, selenium, phosphorus, and the like.

Patient: As used herein, "patient" refers to a subject who may seek or be in need of treatment, requires treatment, is receiving treatment, will receive treatment, or a subject who is under care by a trained professional for a particular disease or condition.

Peptide: As used herein, "peptide" is less than or equal to 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Pharmaceutically acceptable excipients: The phrase "pharmaceutically acceptable excipient," as used herein, refers any ingredient other than the compounds described herein (for example, a vehicle capable of suspending or dissolving the active compound) and having the properties of being substantially nontoxic and non-inflammatory in a patient. Excipients may include, for example: antiadherents, antioxidants, binders, coatings, compression aids, disintegrants, dyes (colors), emollients, emulsifiers, fillers (diluents), film formers or coatings, flavors, fragrances, glidants (flow enhancers), lubricants, preservatives, printing inks, sorbents, suspending or dispersing agents, sweeteners, and waters of hydration. Exemplary excipients include, but are not limited to: butylated hydroxytoluene (BHT), calcium carbonate, calcium phosphate (dibasic), calcium stearate, croscarmellose, crosslinked polyvinyl pyrrolidone, citric acid, crospovidone, cysteine, ethylcellulose, gelatin, hydroxypropyl cellulose, hydroxypropyl methylcellulose, lactose, magnesium stearate, maltitol, mannitol, methionine, methylcellulose, methyl paraben, microcrystalline cellulose, polyethylene glycol, polyvinyl pyrrolidone, povidone, pregelatinized starch, propyl paraben, retinyl palmitate, shellac, silicon dioxide, sodium carboxymethyl cellulose, sodium citrate, sodium starch glycolate, sorbitol, starch (corn), stearic acid, sucrose, talc, titanium dioxide, vitamin A, vitamin E, vitamin C, and xylitol.

Pharmaceutically acceptable salts: The present disclosure also includes pharmaceutically acceptable salts of the compounds described herein. As used herein, "pharmaceutically acceptable salts" refers to derivatives of the disclosed compounds wherein the parent compound is modified by converting an existing acid or base moiety to its salt form (e.g., by reacting the free base group with a suitable organic acid). Examples of pharmaceutically acceptable salts include, but are not limited to, mineral or organic acid salts of basic residues such as amines; alkali or organic salts of acidic residues such as carboxylic acids; and the like. Representative acid addition salts include acetate, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, fumarate, glucoheptonate, glycerophosphate, hemi sulfate, heptonate, hexanoate, hydrobromide, hydrochloride, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, toluenesulfonate, undecanoate, valerate salts, and the like. Representative alkali or alkaline earth metal salts include sodium, lithium, potassium, calcium, magnesium, and the like, as well as nontoxic ammonium, quaternary ammonium, and amine cations, including, but not limited to ammonium, tetramethylammonium, tetraethylammonium, methylamine, dimethylamine, trimethylamine, triethylamine, ethylamine, and the like. The pharmaceutically acceptable salts of the present disclosure include the conventional non-toxic salts of the parent compound formed, for example, from non-toxic inorganic or organic acids. The pharmaceutically acceptable salts of the present disclosure can be synthesized from the parent compound which contains a basic or acidic moiety by conventional chemical methods. Generally, such salts can be prepared by reacting the free acid or base forms of these compounds with a stoichiometric amount of the appropriate base or acid in water or in an organic solvent, or in a mixture of the two; generally, nonaqueous media like ether, ethyl acetate, ethanol, isopropanol, or acetonitrile are preferred. Lists of suitable salts are found in *Remington's Pharmaceutical Sciences*, 17$^{th}$ ed., Mack Publishing Company, Easton, Pa., 1985, p. 1418, *Pharmaceutical Salts: Properties, Selection, and Use*, P. H. Stahl and C. G. Wermuth (eds.), Wiley-VCH, 2008, and Berge et al., *Journal of Pharmaceutical Science*, 66, 1-19 (1977), each of which is incorporated herein by reference in its entirety.

Pharmaceutically acceptable solvate: The term "pharmaceutically acceptable solvate," as used herein, means a compound of the invention wherein molecules of a suitable solvent are incorporated in the crystal lattice. A suitable solvent is physiologically tolerable at the dosage administered. For example, solvates may be prepared by crystallization, recrystallization, or precipitation from a solution that includes organic solvents, water, or a mixture thereof. Examples of suitable solvents are ethanol, water (for example, mono-, di-, and tri-hydrates), N-methylpyrrolidinone (NMP), dimethyl sulfoxide (DMSO), N,N'-dimethylformamide (DMF), N,N'-dimethylacetamide (DMAC), 1,3-dimethyl-2-imidazolidinone (DMEU), 1,3-dimethyl-3,4,5,6-tetrahydro-2-(1H)-pyrimidinone (DMPU), acetonitrile (ACN), propylene glycol, ethyl acetate, benzyl alcohol, 2-pyrrolidone, benzyl benzoate, and the like. When water is the solvent, the solvate is referred to as a "hydrate."

Pharmacologic effect: As used herein, a "pharmacologic effect" is a measurable biologic phenomenon in an organism or system which occurs after the organism or system has been contacted with or exposed to an exogenous agent. Pharmacologic effects may result in therapeutically effective outcomes such as the treatment, improvement of one or more symptoms, diagnosis, prevention, and delay of onset of disease, disorder, condition or infection. Measurement of such biologic phenomena may be quantitative, qualitative or relative to another biologic phenomenon. Quantitative measurements may be statistically significant. Qualitative measurements may be by degree or kind and may be at least 10%, 20%, 30%, 40%, 50%, 60%, 70%, 80%, 90% or more different. They may be observable as present or absent, better or worse, greater or less. Exogenous agents, when referring to pharmacologic effects are those agents which are, in whole or in part, foreign to the organism or system. For example, modifications to a wild type biomolecule, whether structural or chemical, would produce an exogenous agent. Likewise, incorporation or combination of a wild type molecule into or with a compound, molecule or substance not found naturally in the organism or system would also produce an exogenous agent. The saRNA of the present invention, comprises exogenous agents. Examples of pharmacologic effects include, but are not limited to, alteration in cell count such as an increase or decrease in neutrophils, reticulocytes, granulocytes, erythrocytes (red blood cells), megakaryocytes, platelets, monocytes, connective tissue macrophages, epidermal langerhans cells, osteoclasts, dendritic cells, microglial cells, neutrophils, eosinophils, basophils, mast cells, helper T cells, suppressor T cells, cytotoxic T cells, natural killer T cells, B cells, natural killer cells, or reticulocytes. Pharmacologic effects also include alterations in blood chemistry, pH, hemoglobin, hematocrit, changes in levels of enzymes such as, but not limited to, liver enzymes AST and ALT, changes in lipid profiles, electrolytes, metabolic markers, hormones or other marker or profile known to those of skill in the art.

Physicochemical: As used herein, "physicochemical" means of or relating to a physical and/or chemical property.

Preventing: As used herein, the term "preventing" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prodrug: The present disclosure also includes prodrugs of the compounds described herein. As used herein, "prodrugs" refer to any substance, molecule or entity which is in a form predicate for that substance, molecule or entity to act as a therapeutic upon chemical or physical alteration. Prodrugs may by covalently bonded or sequestered in some way and which release or are converted into the active drug moiety prior to, upon or after administered to a mammalian subject. Prodrugs can be prepared by modifying functional groups present in the compounds in such a way that the modifications are cleaved, either in routine manipulation or in vivo, to the parent compounds. Prodrugs include compounds wherein hydroxyl, amino, sulfhydryl, or carboxyl groups are bonded to any group that, when administered to a mammalian subject, cleaves to form a free hydroxyl, amino, sulfhydryl, or carboxyl group respectively. Preparation and use of prodrugs is discussed in T. Higuchi and V. Stella, "Prodrugs as Novel Delivery Systems," Vol. 14 of the A.C.S. Symposium Series, and in *Bioreversible Carriers in Drug Design*, ed. Edward B. Roche, American Pharmaceutical Association and Pergamon Press, 1987, both of which are hereby incorporated by reference in their entirety.

Prognosing: As used herein, the term "prognosing" means a statement or claim that a particular biologic event will, or is very likely to, occur in the future.

Progression: As used herein, the term "progression" or "cancer progression" means the advancement or worsening of or toward a disease or condition.

Proliferate: As used herein, the term "proliferate" means to grow, expand or increase or cause to grow, expand or increase rapidly. "Proliferative" means having the ability to proliferate. "Anti-proliferative" means having properties counter to or inapposite to proliferative properties.

Protein: A "protein" means a polymer of amino acid residues linked together by peptide bonds. The term, as used herein, refers to proteins, polypeptides, and peptides of any size, structure, or function. Typically, however, a protein will be at least 50 amino acids long. In some instances the protein encoded is smaller than about 50 amino acids. In this case, the polypeptide is termed a peptide. If the protein is a short peptide, it will be at least about 10 amino acid residues long. A protein may be naturally occurring, recombinant, or synthetic, or any combination of these. A protein may also comprise a fragment of a naturally occurring protein or peptide. A protein may be a single molecule or may be a multi-molecular complex. The term protein may also apply to amino acid polymers in which one or more amino acid residues are an artificial chemical analogue of a corresponding naturally occurring amino acid.

Protein expression: The term "protein expression" refers to the process by which a nucleic acid sequence undergoes translation such that detectable levels of the amino acid sequence or protein are expressed.

Purified: As used herein, "purify," "purified," "purification" means to make substantially pure or clear from unwanted components, material defilement, admixture or imperfection.

Regression: As used herein, the term "regression" or "degree of regression" refers to the reversal, either phenotypically or genotypically, of a cancer progression. Slowing or stopping cancer progression may be considered regression.

Sample: As used herein, the term "sample" or "biological sample" refers to a subset of its tissues, cells or component parts (e.g. body fluids, including but not limited to blood, mucus, lymphatic fluid, synovial fluid, cerebrospinal fluid, saliva, amniotic fluid, amniotic cord blood, urine, vaginal fluid and semen). A sample further may include a homogenate, lysate or extract prepared from a whole organism or a subset of its tissues, cells or component parts, or a fraction or portion thereof, including but not limited to, for example, plasma, serum, spinal fluid, lymph fluid, the external sections of the skin, respiratory, intestinal, and genitourinary tracts, tears, saliva, milk, blood cells, tumors, organs. A sample further refers to a medium, such as a nutrient broth or gel, which may contain cellular components, such as proteins or nucleic acid molecule.

Signal Sequences: As used herein, the phrase "signal sequences" refers to a sequence which can direct the transport or localization of a protein.

Single unit dose: As used herein, a "single unit dose" is a dose of any therapeutic administered in one dose/at one time/single route/single point of contact, i.e., single administration event.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Split dose: As used herein, a "split dose" is the division of single unit dose or total daily dose into two or more doses.

Stable: As used herein "stable" refers to a compound that is sufficiently robust to survive isolation to a useful degree of purity from a reaction mixture, and preferably capable of formulation into an efficacious therapeutic agent.

Stabilized: As used herein, the term "stabilize", "stabilized," "stabilized region" means to make or become stable.

Subject: As used herein, the term "subject" or "patient" refers to any organism to which a composition in accordance with the invention may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Substantially equal: As used herein as it relates to time differences between doses, the term means plus/minus 2%.

Substantially simultaneously: As used herein and as it relates to plurality of doses, the term means within 2 seconds.

Suffering from: An individual who is "suffering from" a disease, disorder, and/or condition has been diagnosed with or displays one or more symptoms of a disease, disorder, and/or condition.

Susceptible to: An individual who is "susceptible to" a disease, disorder, and/or condition has not been diagnosed with and/or may not exhibit symptoms of the disease, disorder, and/or condition but harbors a propensity to develop a disease or its symptoms. In some embodiments, an individual who is susceptible to a disease, disorder, and/or condition (for example, cancer) may be characterized by one or more of the following: (1) a genetic mutation associated with development of the disease, disorder, and/or condition; (2) a genetic polymorphism associated with development of the disease, disorder, and/or condition; (3) increased and/or decreased expression and/or activity of a protein and/or nucleic acid associated with the disease, disorder, and/or condition; (4) habits and/or lifestyles associated with development of the disease, disorder, and/or condition; (5) a family history of the disease, disorder, and/or condition; and (6) exposure to and/or infection with a microbe associated with development of the disease, disorder, and/or condition. In some embodiments, an individual who is susceptible to a disease, disorder, and/or condition will develop the disease, disorder, and/or condition. In some embodiments, an individual who is susceptible to a disease, disorder, and/or condition will not develop the disease, disorder, and/or condition.

Sustained release: As used herein, the term "sustained release" refers to a pharmaceutical composition or compound release profile that conforms to a release rate over a specific period of time.

Synthetic: The term "synthetic" means produced, prepared, and/or manufactured by the hand of man. Synthesis of polynucleotides or polypeptides or other molecules of the present invention may be chemical or enzymatic.

Targeted Cells: As used herein, "targeted cells" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Total daily dose: As used herein, a "total daily dose" is an amount given or prescribed in 24 hr period. It may be administered as a single unit dose.

Transcription factor: As used herein, the term "transcription factor" refers to a DNA-binding protein that regulates transcription of DNA into RNA, for example, by activation or repression of transcription. Some transcription factors effect regulation of transcription alone, while others act in concert with other proteins. Some transcription factor can both activate and repress transcription under certain conditions. In general, transcription factors bind a specific target sequence or sequences highly similar to a specific consensus sequence in a regulatory region of a target gene. Transcription factors may regulate transcription of a target gene alone or in a complex with other molecules.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

The phrase "a method of treating" or its equivalent, when applied to, for example, cancer refers to a procedure or course of action that is designed to reduce, eliminate or prevent the number of cancer cells in an individual, or to alleviate the symptoms of a cancer. "A method of treating" cancer or another proliferative disorder does not necessarily mean that the cancer cells or other disorder will, in fact, be completely eliminated, that the number of cells or disorder will, in fact, be reduced, or that the symptoms of a cancer or other disorder will, in fact, be alleviated. Often, a method of treating cancer will be performed even with a low likelihood of success, but which, given the medical history and estimated survival expectancy of an individual, is nevertheless deemed an overall beneficial course of action.

Tumor growth: As used herein, the term "tumor growth" or "tumor metastases growth", unless otherwise indicated, is used as commonly used in oncology, where the term is principally associated with an increased mass or volume of the tumor or tumor metastases, primarily as a result of tumor cell growth.

Tumor Burden: As used herein, the term "tumor burden" refers to the total Tumor Volume of all tumor nodules with a diameter in excess of 3 mm carried by a subject.

Tumor Volume: As used herein, the term "tumor volume" refers to the size of a tumor. The tumor volume in $mm^3$ is calculated by the formula: volume=(width)$^2$×length/2.

Unmodified: As used herein, "unmodified" refers to any substance, compound or molecule prior to being changed in any way. Unmodified may, but does not always, refer to the wild type or native form of a biomolecule. Molecules may undergo a series of modifications whereby each modified molecule may serve as the "unmodified" starting molecule for a subsequent modification.

Equivalents and Scope

Those skilled in the art will recognize, or be able to ascertain using no more than routine experimentation, many equivalents to the specific embodiments in accordance with the invention described herein. The scope of the present invention is not intended to be limited to the above Description, but rather is as set forth in the appended claims.

In the claims, articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention includes embodiments in which more than one, or all of the group members are present in, employed in, or otherwise relevant to a given product or process.

It is also noted that the term "comprising" is intended to be open and permits the inclusion of additional elements or steps.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the invention, to the tenth of the unit of the lower limit of the range, unless the context clearly dictates otherwise.

In addition, it is to be understood that any particular embodiment of the present invention that falls within the prior art may be explicitly excluded from any one or more of the claims. Since such embodiments are deemed to be known to one of ordinary skill in the art, they may be excluded even if the exclusion is not set forth explicitly herein. Any particular embodiment of the compositions of the invention (e.g., any nucleic acid or protein encoded thereby; any method of production; any method of use; etc.) can be excluded from any one or more claims, for any reason, whether or not related to the existence of prior art.

All cited sources, for example, references, publications, databases, database entries, and art cited herein, are incorporated into this application by reference, even if not expressly stated in the citation. In case of conflicting statements of a cited source and the instant application, the statement in the instant application shall control.

The invention is further illustrated by the following non-limiting examples.

EXAMPLES

Materials and Procedures:
Transfection of C/EBPα-saRNA into HepG2 and Rat-liver Epithelial Cell Lines HepG2 is a liver cell line derived from a human hepatoblastoma that is free of known hepatotropic viral agents and expresses genes involved in a wide variety of liver-specific metabolic functions. HepG2 cells were cultured in Roswell Park Memorial Institute medium (RPMI) supplemented with 100 units/ml penicillin, 0.1 mg/ml streptomycin, 2 mmol/L glutamine (SIGMA) and 10% fetal bovine serum (LABTECH INTERNATIONAL). For C/EBPα-saRNA transfection, cells were grown to 60% confluency in 24 well plates prior to transfection of 5, 10 and 20 nmols of saRNA using nanofectamine (PAA, UK) following manufacturer's protocol. This process was repeated three times at 16 hours intervals before cells were harvested for isolation of total RNA for mRNA analysis.
Albumin ELISA Rat liver epithelial cells and HepG2 cells were cultured in phenol-red free RPMI media in the presence of charcoal stripped FCS. Following three sets of saRNA transfections at 8 hours, 16 hours and 24 hours, the culture media was collected for total murine albumin ELISA (ASSAY MAX, ASSAY PRO USA) following the manufacturer's instructions.
WST-1 Assay Cell proliferation was quantified at 16, 24 and 96 hours following C/EBPα-saRNA transfection by mitochondrial dehydrogenase expression analysis, using WST-1 reagent following the manufacturer's guideline (ROCHE, UK). Briefly, the WST-1 reagent was used at 1:100 dilution to plates and incubated for one hour. The enzymatic reaction was measured at 450 nm using BIO-TEK ELISA reader.
Isolation of Total RNA from Cell Lines Total RNA extraction form cell lines was performed using the RNAQUEOUS-MICRO kit (AMBION, UK) following the manufacturer's instructions. Briefly, the cells were gently centrifuged followed by 3 pulses of sonication at Output 3 in lysis buffer (AMBION, UK). The cell lysates were then processed through an RNA binding column, followed by multiple washes and elution. The total RNA isolated was quantified by a NANODROP 2000 spectrophotometer. 500 ng of total extracted RNA was processed for elimination of genomic DNA followed by reverse transcription using the QUANTITECT® Reverse Transcription kit from QIAGEN.
Animal Experiments A clinically relevant rat liver tumor model previously described was used [Huang et al., Mol Ther, vol. 16, 1681-1687 (2008), the contents of which are incorporated herein by reference in their entirety]. For in vivo therapy C/EBPα-saRNA was reconstituted with 100 ul of TEA core PAMAM dendrimer (Centre Interdisciplinaire de Nanoscience de Marseille, 13288 Marseille, France). 10 cirrhotic animals were treated with 3× doses via tail vein injections in the 1$^{st}$ week. Control animals (n=10) were injected with equal volume of phosphate buffered saline (PBS) or scramble-saRNA. All animals received humane care according to the criteria outlined in the "Guide for the Care and Use of Laboratory Animals" prepared by the National Academy of Sciences and published by the National Institutes of Health (NIH publication 86-23 revised 1985). The following sequences of scramble-saRNA were used:

```
                                     (SEQ ID NO. 33)
Scramble saRNA_SS: ACUACUGAGUGACAGUAGAUU (SEQ ID NO. 34)
Scramble saRNA_AS: UCUACUGUCA-CUCAGUAGUU
```

Gene Microarray Profile

The Human Liver Cancer RT$^2$ Profiler™ (QIAGEN, Germantown, Md.) was used to profile the expression of 84 key genes involved in the progression of hepatocellular carcinoma. 500 ng of purified RNA was reverse transcribed for 15 min with RT$^2$ Frist Strand kit (QIAGEN, Germantown, Md.) using random hexamers and oligo-dT primers for unbiased reverse transcription. First strand synthesized cDNA was then transferred into the array plates for amplification in a 7900HT Applied Biosystems Real Time cycler using RT$^2$ SYBR® Green ROX™ qPCR Master mix (QIAGEN, Germantown, Md.) at 1 cycle for 10 min at 95° C. and 40 cycles (15 sec at 95° C. and 1 min at 60° C.) for fluorescence data collection. Threshold cycle ($C_T$) for each well was manually calculated and exported for data analysis and clustering using SABiosciences array specific Data Analysis software (QIAGEN, Germantown, Md.).
Assessment of Tumor Burden To assess tumor progression after treatment, all the treated animals were killed 1 week after C/EBPα-saRNA-dendrimer injection. The body, liver, lung, and spleen were weighed, and the aspects of all organs were recorded. After the animals were killed, all liver lobes were promptly removed and weighed, and the diameters of all the macroscopically visible nodules on the liver surface and in the 5 mm sliced sections were measured. Tumor burden was determined in terms of the total volume of all the tumor nodules with diameter >3 mm.

Example 1

Therapeutic Effect of C/EBPα-saRNA in Treating Liver Cirrhosis and HCC

Additional experimental procedures may be found in the accepted manuscript of Reebye et al. published by Hepatology on Aug. 8, 2013, the contents of which are incorporated herein by reference in their entirety.
Expression Level of C/EBPα and Albumin in HepG2 Cells Transfected with C/EBPα-saRNA The effect of transfecting C/EBPα-saRNA on C/EBPα and albumin transcript levels was assessed. The following C/EBPα-saRNA duplex (sense/antisense) targeted to C/EBPα was used for this study:

```
                                      (SEQ ID NO. 1)
AW1 sense strand:      CGGUCAUUGUCACUGGUCA (SEQ ID NO. 2)
AW1 antisense strand:  UGACCAGUGACAAUGACCG
```

The properties of the saRNA molecules are as follows:

| Property | AW1 sense | AW2 sense |
|---|---|---|
| GC content | 47.6% | 47.6% |
| Melting temperature | 67.4° C. | 69.9° C. |
| Molecular Weight | 6627.0 g/mol | 6696.1 g/mol |

-continued

| Property | AW1 sense | AW2 sense |
|---|---|---|
| Extinction Coefficient | 201800 L/(mol · cm) | 209600 L/(mol · cm) |
| nmol/OD$_{260}$ | 4.95 | 4.77 |
| ug/OD$_{260}$ | 32.84 | 31.95 |

Figure 3A:
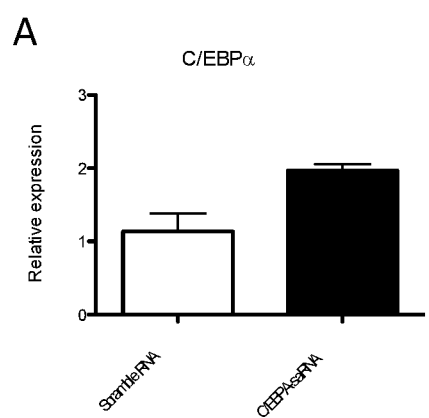
Figure 3B:
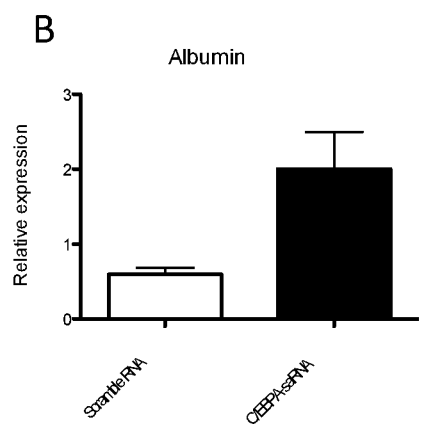
Figure 3C:
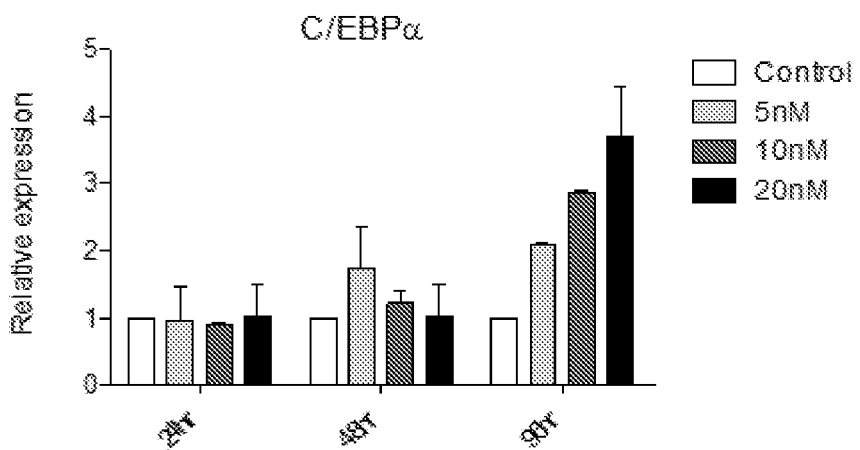
Figure 3D:
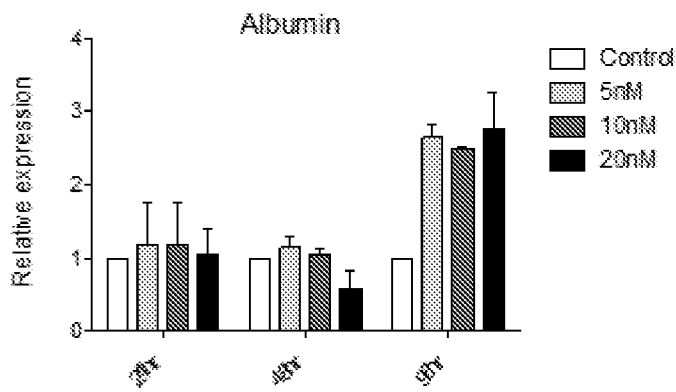
Figure 4A:
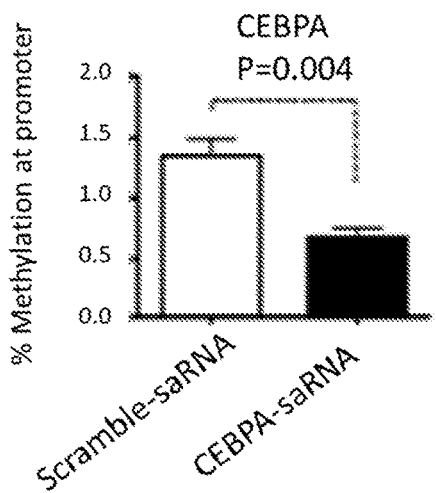
FIG. 4A-4F illustrate studies of the methylation status and effects on gene expression. A-B shows methylation assay of the CpG islands at the promoter regions of (FIG. 4A) C/EBPA and (FIG. 4B) DBP demonstrated reduction in methylation when compared to control.
Figure 4B:
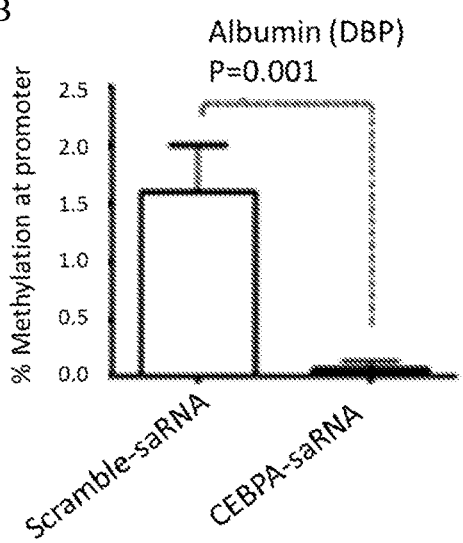

Upon transfection of 20 nM C/EBPα-saRNA, both C/EBPα (FIG. 3A) and albumin mRNA transcripts (FIG. 3B) increased over two fold. Increasing the amounts of C/EBPα-saRNA (5, 10, and 20 nM) dose dependently enhanced C/EBPα mRNA transcript levels (FIG. 3C). The maximum expression of albumin was achieved with 50 nM of C/EBPα-saRNA, with no further dose dependent increase at higher saRNA levels (FIG. 3D). Analysis of the promoter regions of C/EBPα (FIG. 3E), the binding box of albumin promoter (albumin D-box) binding protein (DBP) (FIG. 3F) and albumin (FIG. 3G) showed the presence of the core C/EBPα binding motifs (GCAAT). An EPITECT™ Methyl PCR assay also demonstrated reduced methylation at the CpG islands of both C/EBPA and DBP promoters following transfection of C/EBPα-saRNA (FIGS. 4A and 4B).

Figure 4C:
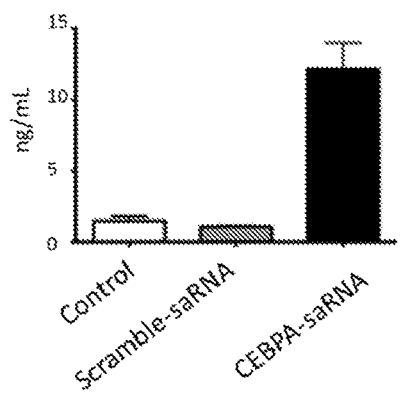
Figure 4D:
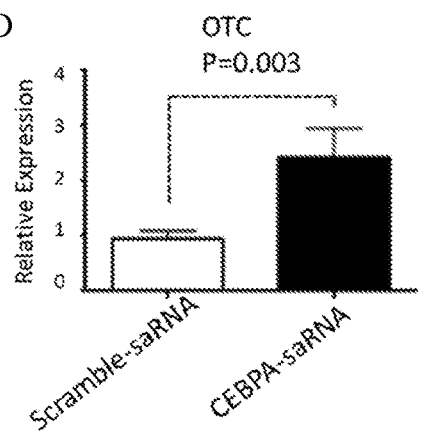
Figure 4E:
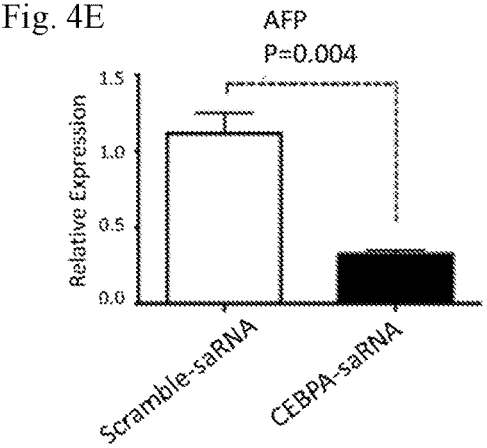
Figure 4F:
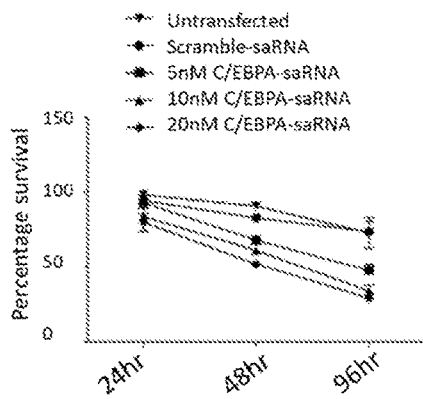

To determine the biological relevance of increased albumin mRNA transcripts in C/EBPα-saRNA transfected HepG2 cells, a human albumin specific enzyme-linked immunosorbent assay (ELISA) was performed. Secreted albumin peptide was detected in the culture media of the transfected cells (FIG. 4C). To establish if enhanced albumin secretion in HepG2 cells by C/EBPα-saRNA also affected other hepatocytes specific functions and maintenance of hepatocyte differentiation, expression levels of the ornithine cycle enzyme ornithine transcarbamylase (OTC) and alpha-fetoprotein (AFP) were each measured by measuring mRNA transcripts levels. C/EBPα-saRNA caused an increase in OTC expression levels (FIG. 4D) suggesting an improved ability of urea production. The expression level of AFP decreased (FIG. 4E) indicative of the negative regulation typically observed with normal hepatocytes. In addition to the observed gene expression changes described, it is also observed that C/EBPα-saRNA caused a marked down-regulation of HepG2 cell proliferation (FIG. 4F). This observation confirms the known anti-proliferative effects of C/EBPα.

Figure 5A:
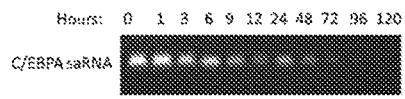
FIG. 5A-5F illustrate the results of in vivo studies of the saRNA of the invention.
Figure 5B:
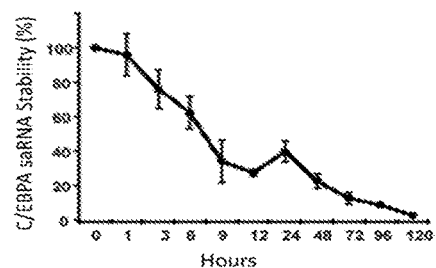

Intravenous Injection of C/EBPα-saRNA in Male Wistar Rats Bearing Liver Cirrhosis/Hepatocellular Carcinoma (HCC) Promoted Increased Circulating Levels of Albumin, Amelioration of Liver Function and a Reduced Tumor Burden C/EBPα-RNA was assembled into poly(amidoamine) (PAMAM) dendrimers, called C/EBPα-saRNA-dendrimer, for delivery intravenously. The stability of C/EBPα-saRNA was initially tested in circulating serum by performing a nuclease activity assay using blood samples from C/EBPα-saRNA treated rats. A significant reduction in the stability of C/EBPα-saRNA duplex by 48 hours was observed (FIGS. 5A and 5B). Thus, cirrhotic rats were injected over a period of one week with repeat doses of 200 uL of 0.1 nmol/uL C/EBPα-saRNA-dendrimer. A standard dose was made from 50 uL of 20 nanomoles C/EBPα-saRNA mixed with 50 uL generation 5 triethanolamine (TEA)-core PAMAM dendrimer and 100 uL of RNase/Dnase free water. The concentration of C/EBPα-saRNA was 0.1 nmol/uL.

Figure 5C:
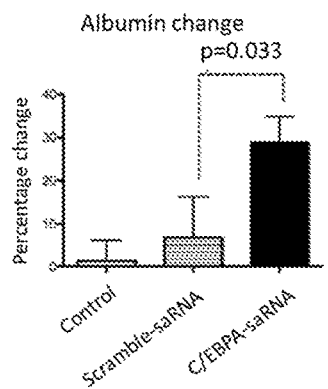
Figure 5D:
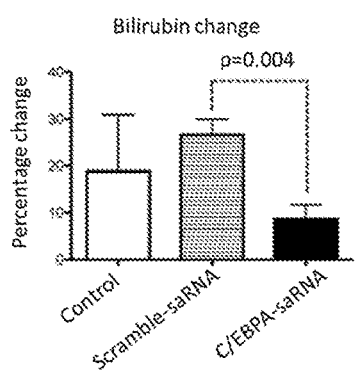
Figure 5E:
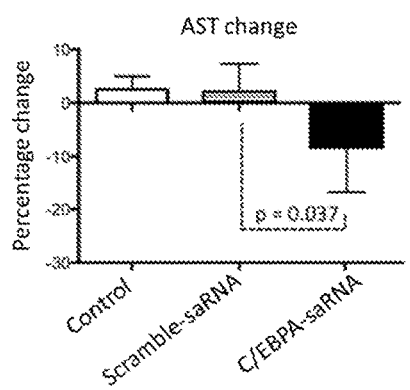
Figure 5F:
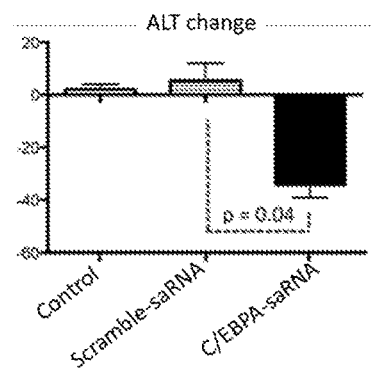
Figure 6A:
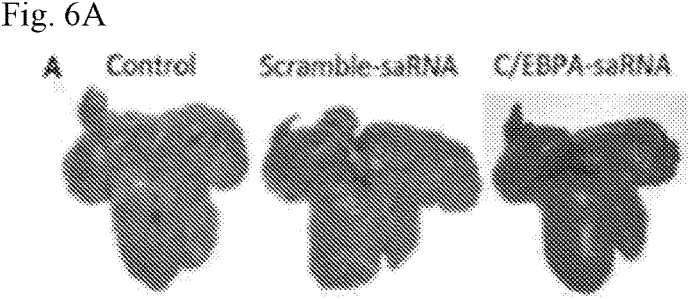
FIG. 6A-6C illustrate whole tissue and histochemistry studies of the saRNA of the present invention.
Figure 6B:
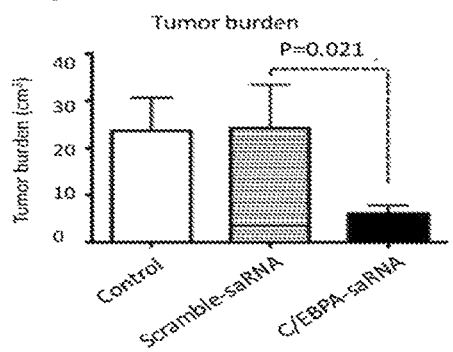
Figure 6C:
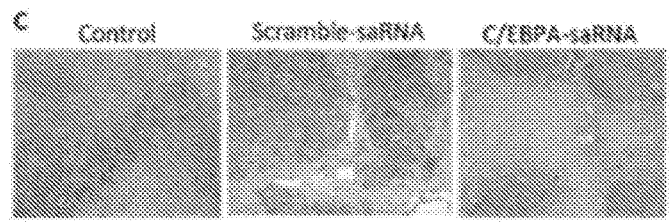

Measurement of circulating albumin showed a significant increase of over 30% after three doses of 200 uL of 0.1 nmol/uL C/EBPα-saRNA-dendrimer injection when compared to PBS control or scramble-saRNA-dendrimer control groups (FIG. 5C). Further blood analysis demonstrated that bilirubin levels was significantly lower in the C/EBPα-saRNA-dendrimer treated group by at least 17% when compared to both control groups (FIG. 5D). There was also a significant drop in levels of the liver enzymes aspartate aminotransferase (AST) and alanine aminotransferase (ALT) by at least 10% and 30% respectively in the C/EBPα-saRNA-dendrimer treated group when compared to both control groups (FIGS. 5E and 5F). Histological examination of the liver showed a significant reduction in tumor nodules from C/EBPα-saRNA-dendrimer injected rats when compared to both control groups (FIGS. 6A and 6B). These results were consistent with immunohistology studies of tissue sections from C/EBPα-saRNA treated rat liver stained for placenta-form of glutathione S-transferase (GST-p). Independent analysis suggested that there was evidence of reduced carcinogenesis by treatment with C/EBPα-saRNA-dendrimer when compared to the PBS control or scramble-saRNA-dendrimer control groups. Furthermore, there were no differences in liver fibrosis between the PBS control, scramble-saRNA-dendrimer or C/EBPα-saRNA-dendrimer treated groups (FIG. 6C). The average density of positive staining for GST-p from control groups was 70 (±5.0%), and that from C/EBPα-saRNA-dendrimer injected rats was 32 (±6.5%). Since overexpression of GST-p is observed during rat liver pre-neoplastic state and neoplastic transformation, this data suggests that C/EBPα-saRNA-dendrimer treatment may reduce this process.

Figure 7A:
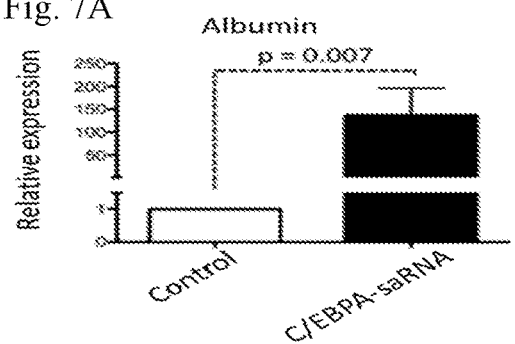
FIG. 7A-7G illustrate the results of in vivo studies of the saRNA of the invention.
Figure 7B:
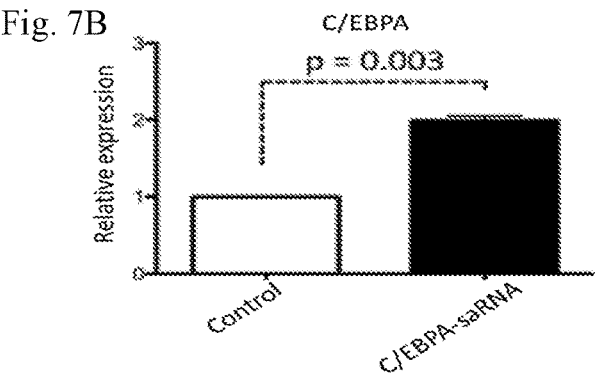
Figure 7C:
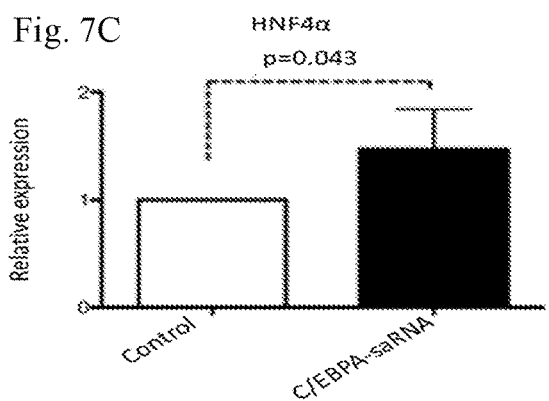
Figure 7D:
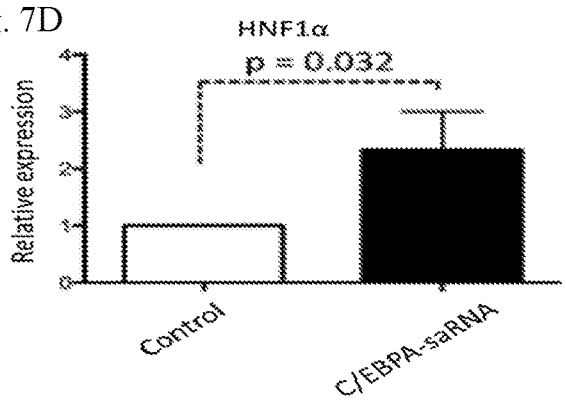
Figure 7E:
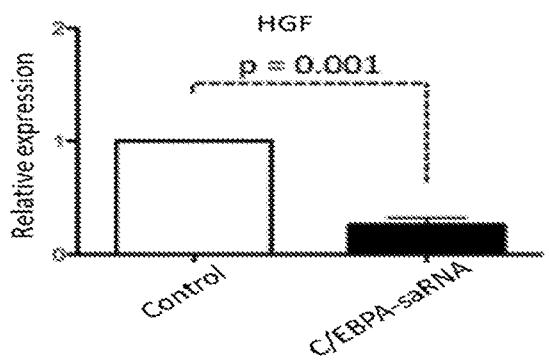
Figure 7F:
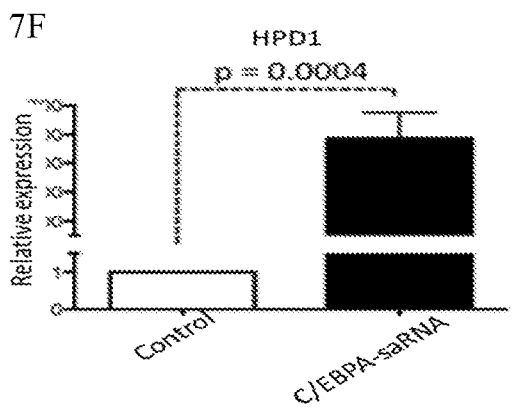
Figure 7G:
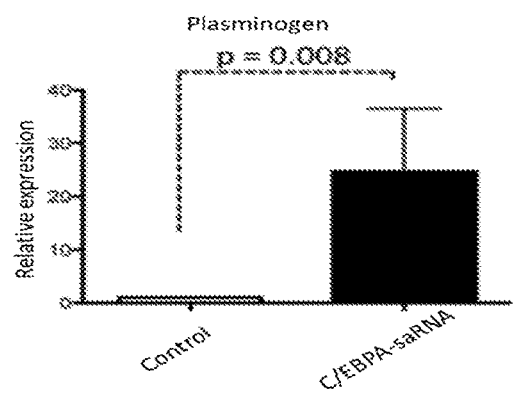

Total RNA extracted from liver biopsies of 7 animals from each group were screened for mRNA transcript levels of albumin (FIG. 7A), C/EBPα (FIG. 7B), hepatocyte nuclear factor 4-alpha (HNF4α) (FIG. 7C) and hepatocyte nuclear factor 1-alpha (HNF1α) (FIG. 7D). A significant increase in mRNA level was observed for all the factors, consistent with the role of HNF4a in hepatocyte differentiation together with C/EBPα and HNF1α in promoting expression of albumin. Taken together, lower mRNA levels of hepatocyte growth factor (HGF) (FIG. 7E) and increased levels of 4-hydroxyphenylpyruvic acid dioxygenase (HPD1) (FIG. 7F) and plasminogen (FIG. 7G) were suggestive of improved liver function in these cirrhotic rats treated with C/EBPα-saRNA-dendrimer. Therefore, treatments with C/EBPα-saRNA not only show utility in cancer therapy, but show improved organ function in the liver.

Pathway Gene Microarray Analysis Suggests that C/EBPα-saRNA Contributes to Up-regulation of Tumor Suppressor Genes and Down-regulation of Genes Involves in Liver Cancer To investigate other liver specific factors that might be affected in response to C/EBPα-saRNA; the gene expression profiles of a panel of 84 liver cancer specific genes (QIAGEN/SABIOSCIENCES Human Liver Cancer RT$^2$ PROFILER™) in C/EBPα-saRNA transfected HepG2 cells were analyzed. Of particular interest was the observed up-regulation of 20 genes (Table 5), 18 of which are known tumor suppressor genes in HCC (Table 7) including retinoblastoma (RB). The most significantly up-regulated (over 3 fold) included the death agonist gene BH3-interacting domain (BID), and tumor protein 53 gene (TP53), encoding p53. BID interacts with BCl2-associated X protein (BAX) which in turn is up-regulated by wild type p53 to regulate cell cycle arrest and apoptosis in response to DNA damage. The genes down-regulated are shown in Table 6.

TABLE 5

Gene expression (up-regulated by C/EBPα-saRNA)

| Gene Symbol | Name | SEQ ID | RefSEQ | Fold Up | p value |
|---|---|---|---|---|---|
| BAX | BCL2-associated X protein | 35 | NM_004324.3 | 1.12 | 0.0027 |
| BID | BH3 interacting domain death agonist | 36 | NM_197966.2 | 13.58 | 0.0001 |
| CASP8 | Caspase 8 | 37 | NM_001080125.1 | 6.69 | 0.0000 |
| DAB2IP | Disabled homolog 2-interacting protein | 38 | NM_032552.2 | 2.59 | 0.0042 |
| DLC1 | Deleted in Liver Cancer 1 | 39 | NM_182643.2 | 4.84 | 0.0001 |
| FAS | Fas cell surface death receptor | 40 | NM_000043.4 | 1.64 | 0.0004 |
| FHIT | fragile histidine triad | 41 | NM_001166243.1 | 2.84 | 0.0021 |
| GADD45B | growth arrest and DNA-damage-inducible, beta | 42 | NM_015675.3 | 3.35 | 0.0001 |
| HHIP | hedgehog interacting protein | 43 | NM_022475.2 | 1.59 | 0.0054 |
| IGF2 | insulin-like growth factor 2 | 44 | NM_000612.4 | 9.75 | 0.0001 |
| LEF1 | lymphoid enhancer-binding factor 1 | 45 | NM_016269.4 | 17.86 | 0.0001 |
| PTEN | phosphatase and tensin homolog | 46 | NM_000314.4 | 1.28 | 0.0013 |
| PTK2 | protein tyrosine kinase 2 | 47 | NM_001199649.1 | 2.87 | 0.0001 |
| RB1 | retinoblastoma 1 | 48 | NM_000321.2 | 1.96 | 0.0001 |
| RUNK3 | runt-related transcription factor 3 | 49 | NM_001031680.2 | 6.01 | 0.0002 |
| SMAD4 | SMAD family member 4 | 50 | NM_005359.5 | 1.72 | 0.0019 |
| SOCS3 | suppressor of cytokine signaling 3 | 51 | NM_003955.4 | 6.52 | 0.0003 |
| TGFBR2 | transforming growth factor, beta receptor II | 52 | NM_001024847.2 | 3.71 | 0.0025 |
| TNFSF10 | tumor necrosis factor (ligand) superfamily, member 10 | 53 | NM_003810.3 | 3.53 | 0.0003 |
| TP53 | tumor protein p53 | 54 | NM_001126114.2 | 3.91 | 0.0018 |

TABLE 6

Gene expression (down-regulated by C/EBPα-saRNA)

| Gene Symbol | Name | SEQ ID | RefSEQ | Fold Down | p value |
|---|---|---|---|---|---|
| ADAM17 | Disintegrin and metalloproteinase domain-containing protein 17 | 55 | NM_003183.4 | −2.19 | 0.0007 |
| AKT1 | v-akt murine thymoma viral oncogene homolog 1 | 56 | NM_005163.2 | −1.78 | 0.0220 |
| ANGPT2 | angiopoietin 2 | 57 | NM_001147.2 | −1.61 | 0.0097 |
| BCL2 | B-cell CLL/lymphoma 2 | 58 | NM_000633.2 | −2.77 | 0.0177 |
| BCL2L1 | BCL2-like 1 | 59 | NM_138578.1 | −1.77 | 0.0014 |
| BIRC2 | baculoviral IAP repeat containing 2 | 60 | NM_001256163.1 | −2.83 | 0.0054 |
| BIRC5 | baculoviral IAP repeat containing 5 | 61 | NM_001012271.1 | −18.53 | 0.0014 |
| CCL5 | chemokine ligand 5 | 62 | NM_001278736.1 | −35.10 | 0.0001 |
| CCND1 | cyclin D1 | 63 | NM_053056.2 | −6.45 | 0.0001 |
| CCND2 | cyclin D2 | 64 | NM_001759.3 | −2.40 | 0.0001 |
| CDH1 | cadherin 1, type 1, E-cadherin (epithelial) | 65 | NM_004360.3 | −3.04 | 0.0002 |
| CDH13 | cadherin 13 | 66 | NM_001220488.1 | −5.52 | 0.0001 |
| CDKN1A | cyclin-dependent kinase inhibitor 1A | 67 | NM_001220778.1 | −2.53 | 0.0016 |
| CDKN1B | cyclin-dependent kinase inhibitor 1B (p27, Kip1) | 68 | NM_004064.3 | −1.74 | 0.0145 |
| CDKN2A | cyclin-dependent kinase inhibitor 2A | 69 | NM_001195132.1 | −6.75 | 0.0001 |
| CFLAR | CASP8 and FADD-like apoptosis regulator | 70 | NM_001202519.1 | −7.12 | 0.0003 |
| CTNNB1 | catenin (cadherin-associated protein), beta 1 | 71 | NM_001904.3 | −1.59 | 0.0081 |
| CXCR4 | chemokine receptor 4 | 72 | NM_001008540.1 | −2.73 | 0.0004 |
| E2F1 | E2F transcription factor 1 | 73 | NM_005225.2 | −1.40 | 0.0174 |
| EGF | epidermal growth factor | 74 | NM_001963.4 | −8.63 | 0.0074 |
| EGFR | epidermal growth factor receptor | 75 | NM_005228.3 | −2.58 | 0.0064 |
| EP300 | E1A binding protein p300 | 76 | NM_001429.3 | −3.28 | 0.0001 |
| FADD | Fas (TNFRSF6)-associated via death domain | 77 | NM_003824.3 | −1.15 | 0.0001 |
| FLT1 | fms-related tyrosine kinase 1 | 78 | NM_002019.4 | −36.26 | 0.0001 |
| FZD7 | frizzled family receptor 7 | 79 | NM_003507.1 | −2.00 | 0.0004 |

TABLE 6-continued

Gene expression (down-regulated by C/EBPα-saRNA)

| Gene Symbol | Name | SEQ ID | RefSEQ | Fold Down | p value |
|---|---|---|---|---|---|
| GSTP1 | glutathione S-transferase pi 1 | 80 | NM_000852.3 | −1.97 | 0.0019 |
| HGF | hepatocyte growth factor | 81 | NM_000601.4 | −11.07 | 0.0001 |
| HRAS | Harvey rat sarcoma viral oncogene homolog | 82 | NM_176795.3 | −3.69 | 0.0001 |
| IGFBP1 | insulin-like growth factor binding protein 1 | 83 | NM_000596.2 | −7.36 | 0.0001 |
| IGFBP3 | insulin-like growth factor binding protein 3 | 84 | NM_001013398.1 | −17.56 | 0.0001 |
| IRS1 | insulin receptor substrate 1 | 85 | NM_005544.2 | −1.61 | 0.0010 |
| ITGB1 | integrin beta 1 | 86 | NM_002211.3 | −2.48 | 0.0001 |
| KDR | kinase insert domain receptor | 87 | NM_002253.2 | −13.5 | 0.0001 |
| MCL1 | myeloid cell leukemia sequence 1 | 88 | NM_021960.4 | −2.47 | 0.0031 |
| MET | met proto-oncogene | 89 | NM_001127500.1 | −1.30 | 0.0247 |
| MSH2 | mutS homolog 2 | 90 | NM_000251.2 | −1.03 | 0.0057 |
| MSH3 | mutS homolog 3 | 91 | NM_002439.4 | −3.63 | 0.0002 |
| MTDH | metadherin | 92 | NM_178812.3 | −1.73 | 0.0014 |
| MYC | v-myc avian myelocytomatosis viral oncogene homolog | 93 | NM_002467.4 | −1.76 | 0.0132 |
| NKFB1 | nuclear factor of kappa light polypeptide gene enhancer in B-cells 1 | 94 | NM_003998.3 | −1.48 | 0.0365 |
| NRAS | neuroblastoma RAS viral (v-ras) oncogene homolog | 95 | NM_002524.4 | −29.47 | 0.0001 |
| OPCML | opioid binding protein/cell adhesion molecule-like | 96 | NM_001012393.1 | −1.51 | 0.0074 |
| PDGFRA | platelet-derived growth factor receptor, alpha polypeptide | 97 | NM_006206.4 | −1.54 | 0.0019 |
| PIN1 | peptidylprolyl cis/trans isomerase, NIMA-interacting 1 | 98 | NM_006221.3 | −1.15 | 0.0012 |
| PTGS2 | prostaglandin-endoperoxide synthase 2 | 99 | NM_000963.2 | −2.76 | 0.0001 |
| PYCARD | PYD and CARD domain containing | 100 | NM_013258.4 | −1.49 | 0.0178 |
| RAC1 | ras-related C3 botulinum toxin substrate 1 | 101 | NM_018890.3 | −1.46 | 0.0069 |
| RASSF1 | Ras association (RalGDS/AF-6) domain family member 1 | 102 | NM_170714.1 | −4.59 | 0.0001 |
| RELN | reelin | 103 | NM_005045.3 | −2.09 | 0.0005 |
| RHOA | ras homolog family member A | 104 | NM_001664.2 | −1.46 | 0.0019 |
| SFRP2 | secreted frizzled-related protein 2 | 105 | NM_003013.2 | −1.73 | 0.0092 |
| SMAD7 | SMAD family member 7 | 106 | NM_005904.3 | −3.46 | 0.0002 |
| SOCS1 | suppressor of cytokine signaling 1 | 107 | NM_003745.1 | −7.04 | 0.0001 |
| STAT3 | signal transducer and activator of transcription 3 | 108 | NM_139276.2 | −13.06 | 0.0006 |
| TCF4 | transcription factor 4 | 109 | NM_001083962.1 | −9.96 | 0.0008 |
| TERT | telomerase reverse transcriptase | 110 | NM_198253.2 | −1.65 | 0.0005 |
| TGFA | transforming growth factor alpha | 111 | NM_003236.3 | −9.27 | 0.0001 |
| TGFB1 | transforming growth factor beta 1 | 112 | NM_000660.4 | −1.80 | 0.0002 |
| TLR4 | toll-like receptor 4 | 113 | NM_003266.3 | −4.81 | 0.0007 |
| TNFRSF10B | tumor necrosis factor receptor superfamily member 10b | 114 | NM_003842.4 | −1.07 | 0.0063 |
| VEGFA | vascular endothelial growth factor A | 115 | NM_001171623.1 | −1.30 | 0.0429 |
| WT1 | Wilms tumor 1 | 116 | NM_024426.4 | −6.674 | 0.0010 |
| XIAP | X-linked inhibitor of apoptosis | 117 | NM_001167.3 | −2.93 | 0.0228 |
| YAP1 | Yes-associated protein 1 | 118 | NM_001130145.2 | −1.58 | 0.0058 |

Growth arrest and DNA-damage-inducible, 45 beta (GADD45B), also up-regulated, is a member of the growth arrest DNA damage inducible gene family associated with cell growth control where together with p53 induces hepatoprotection in HepG2 cells. Deleted in Liver Cancer 1 (DLC1) gene is a reported tumor suppressor for human liver cancer inhibiting cell growth and proliferation, as well as inducing apoptosis. The data suggests that DLC1 is up-regulated in C/EBPα-saRNA transfected HepG2 cells (Table 7).

TABLE 7

Up-regulation of tumor suppressor genes by C/EBPα-saRNA

| Gene Symbol | SEQ ID | Gene Function | Fold Up | p value |
|---|---|---|---|---|
| BAX | 35 | Apoptosis | 1.12 | 0.0027 |
| BID | 36 |  | 13.58 | 0.0001 |
| CASP8 | 37 | Apoptosis, angiogenesis | 6.69 | 0.0000 |
| DLC1 | 39 | Apoptosis, Ras/Raf/ | 4.84 | 0.0001 |
| FAS | 40 | MEK/ERK, small | 1.64 | 0.0004 |
| FHIT | 41 | GTPase-mediated signaling | 2.84 | 0.0021 |
| GADD45B | 42 | Apoptosis, cell cycle | 3.35 | 0.0001 |
| RUNX3 | 49 |  | 6.01 | 0.0002 |
| SOCS3 | 51 | Apoptosis, adhesion & | 6.52 | 0.0003 |
| TNFSF10 | 53 | proteolysis | 3.53 | 0.0003 |
| PTEN | 46 | Cell cycle, PI3K/AKT, adhesion & proteolysis, angiogenesis | 1.28 | 0.0013 |
| RB1 | 48 | Cell cycle, classical WNT, Ras/Raf/MEK/ERK, small GTPase-mediated sigalling | 1.96 | 0.0001 |
| IGF2 | 44 | Cell cycle, IGF/IGFR signalling | 9.75 | 0.0001 |
| P53 | 54 | DNA damage, Ras/Raf/ MEK/ERK, small GTPase-mediated sigalling | 3.91 | 0.0018 |
| DAB2IP | 38 | Small GPTase-mediated signalling | 2.59 | 0.0042 |
| HHIP | 43 | Hedgehog signalling | 1.59 | 0.0054 |
| SMAD4 | 50 | TGFβ signalling, epithelial to mesenchymal transition | 1.72 | 0.0019 |
| TGFBR2 | 52 | TGFβ signalling, angiogenesis | 3.71 | 0.0025 |

Runt-related transcription factor-3 (RUNX3) is a member of the runt domain family of transcription factor and has been frequently been observed in HCC where its expression is significantly lower than in surrounding normal tissue. Since ectopic expression of RUNX3 reverses epithelial-mesenchymal transition (EMT) in HCC cells, it was also observed, in the C/EBPα-saRNA transfected HepG2 cells, an up-regulation of RUNX3 (Table 6) and down-regulation of 4 genes involved in EMT. These included CTNB1 (encoding β-atenin), Hepatocyte growth factor (HGF), Small body size mothers against decapentaplegic homolog 7 (SMAD7), and Transforming factor beta 1 (TGFB1) (Table 8).

Suppression of cytokine signaling 3 (SOCS3) was also detected. SOCS3 is a member of the STAT-induced STAT inhibitor (SSI) which functions as negative regulators of cytokine signaling. Decreased expression of SOCS3 is correlated with increased phosphorylation of STAT3 in HCC. SOCS3 furthermore has been implicated in negatively regulating cyclin D1 (CCND1), and anti-apoptotic genes including XIAP, survivin (BIRC5), and myeloid leukaemia cell differentiation protein (MCL1). Here, a significant increase in expression of SOC S3 (Table 7) and a significant decrease in STAT3, CCND1, XIAP, BIRC5 and MCL1 expression (Table 8) were observed. The array data also confirmed down-regulation in expression of GSTP1 (Table 8).

Overall, the down-regulated genes were strongly enriched for functions related to negative regulation of apoptosis and cell death (gene ontology (GO) terms GO:0043066 and GO:0060548; p-values $2 \times 10^{-9}$ and $2 \times 10^{-9}$, respectively), whereas the up-regulated genes were enriched for functions related to positive regulation of cell differentiation (GO: 0045597; p=$5 \times 10^{-3}$). Consequently, the data suggest that control of C/EBPα levels and signals may be therapeutic intervention points in liver cancer.

TABLE 8

Analysis of genes down-regulated by C/EBPα-saRNA

| Gene Symbol | SEQ ID | Gene Function | Fold Up | p value |
|---|---|---|---|---|
| CCND1 | 63 | Classical Wnt, cell cycle, DNA damage | −6.45 | 0.0001 |
| CDKN2A | 69 | Classical Wnt, Ras/Raf/MEK/ERK & Small GTPase-mediated signalling, cell cycle | −6.75 | 0.0001 |
| CTNNB1 | 71 | Classical Wnt, epithelial to mesenchymal transition (EMT), angiogenesis | −1.59 | 0.0081 |
| FZD7 | 79 | Classical Wnt | −2.00 | 0.0004 |
| MTDH | 92 |  | −1.73 | 0.0014 |
| PIN1 | 98 |  | −1.15 | 0.0012 |
| TCF4 | 109 |  | −9.96 | 0.0008 |
| SMAD7 | 106 | TGFβ signalling, EMT, adhesion & poteolysis | −3.46 | 0.0002 |
| TGFB1 | 112 | TGFβ signalling, EGFR signalling, EMT, immune & inflammatory response | −1.80 | 0.0002 |
| AKT1 | 56 | P13K/AKY signalling, adhesion & proteolysis | −1.78 | 0.0220 |
| IRS1 | 85 | P13K/AKY signalling | −1.61 | 0.0010 |
| IGFBP1 | 83 | IGF/IGFR signalling | −7.36 | 0.0001 |
| IGFBP3 | 84 |  | −17.56 | 0.0001 |
| IRS1 | 85 |  | −1.61 | 0.0010 |
| YAP1 | 118 | Hippo signaling | −1.58 | 0.0058 |
| CDKN1A | 67 | Ras/Raf/MEK/ERK & small GTPase-mediated signalling, cell cycle, CDKN1A | −2.53 | 0.0016 |
| HRAS | 82 | Ras/Raf/MEK/ERK & small GTPase-mediated | −3.69 | 0.0001 |
| NRAS | 95 | signalling | −29.47 | 0.0001 |
| RAC1 | 101 | Ras/Raf/MEK/ERK & small GTPase-medicated | −1.46 | 0.0069 |

TABLE 8-continued

Analysis of genes down-regulated by C/EBPα-saRNA

| Gene Symbol | SEQ ID | Gene Function | Fold Up | p value |
|---|---|---|---|---|
| RHOA | 104 | signalling, immune & inflammatory response, adhesion & proteolysis | −1.46 | 0.0019 |
| RASSF1 | 102 | Ras/Raf/MEK/ERK & small GTPase-medicated signalling, cell cycle | −4.59 | 0.0001 |
| ADAM17 | 55 | EGFR signalling, adhesion & proteolysis | −2.19 | 0.0007 |
| CDH13 | 66 | EGFR & small GTPase-mediated signalling, adhesion & oroteolysis, angiogenesis | −5.52 | 0.0001 |
| EGF | 74 | EGFR signalling, angiogenesis | −8.63 | 0.0074 |
| EGFR | 75 | EGFR signalling, adhesion & proteolysis | −2.58 | 0.0064 |
| TGFA | 111 | EGFR signalling | −9.27 | 0.0001 |
| HGF | 81 | MET/HGF signalling, EMT | −11.07 | 0.0001 |
| MET | 89 | MET/HGF signalling | −1.30 | 0.0247 |
| RELN | 103 | Small GTPase-mediated signalling, adhesion & proteolysis | −2.09 | 0.0005 |
| CDKN1B | 68 | Cell cycle | −1.74 | 0.0145 |
| MYC | 93 | | −1.76 | 0.0132 |
| E2F1 | 73 | Cell cycle, apoptosis | −1.40 | 0.0174 |
| EP300 | 76 | Cell cycle, apoptosis, adhesion & proteolysis | −2.09 | 0.0005 |
| BCL2 | 58 | Apoptosis | −2.77 | 0.0177 |
| BCL2L1 | 59 | | −1.77 | 0.0014 |
| BIRC2 | 60 | | −2.83 | 0.0054 |
| BIRC5 | 61 | | −18.53 | 0.0014 |
| FADD | 77 | | −1.15 | 0.0001 |
| GSTP1 | 80 | | −1.97 | 0.0019 |
| MCL1 | 88 | | −2.47 | 0.0031 |
| TERT | 110 | | −1.65 | 0.0005 |
| TNFRSF10B | 114 | | −1.07 | 0.0063 |
| WT1 | 116 | | −6.674 | 0.0010 |
| CFLAR | 70 | Apoptosis, adhesion & proteolysis | −7.12 | 0.0003 |
| MSH2 | 90 | Apoptosis, DNA damage | −1.03 | 0.0057 |
| PYCARD | 100 | Apoptosis, adhesion & proteolysis | −1.49 | 0.0178 |
| CCL5 | 62 | Immune & inflammatory response | −35.1 | 0.0001 |
| CXCR4 | 72 | | −2.73 | 0.0004 |
| NKFB1 | 94 | | −1.48 | 0.0365 |
| PTGS2 | 99 | | −2.76 | 0.0001 |
| TLR4 | 113 | | −4.81 | 0.0007 |
| CDH1 | 65 | Adhesion & proteolysis | −3.04 | 0.0002 |
| EGFR | 75 | | −2.58 | 0.0064 |
| EP300 | 76 | | −3.28 | 0.0001 |
| HGF | 81 | | −11.07 | 0.0001 |
| ITGB1 | 86 | | −2.48 | 0.0001 |
| OPCML | 96 | | −1.51 | 0.0074 |
| SOCS1 | 107 | | −7.04 | 0.0001 |
| TERT | 110 | | −1.65 | 0.0005 |
| ANGPT2 | 57 | Angiogenesis | −1.61 | 0.0097 |
| FLT1 | 78 | | −36.26 | 0.0001 |
| KDR | 87 | | −13.5 | 0.0001 |
| PDGFRA | 97 | | −1.54 | 0.0019 |
| VEGFA | 115 | | −1.30 | 0.0429 |

Transfection of C/EBPα-saRNA in HepG2 Suppresses STAT3, IL6R and cMyc in HepG2 Cells Previously published reports demonstrate that interleukin 6 receptor (IL6R) promote hepatic oncogenesis by directly activating signal transducer and activator of transcription 3 (STAT3) and, in turn, up-regulating expression of c-Myc. Since a ChIP-Seq analysis of these 3 genes showed the presence of C/EBPα binding sites within their promoter regions, the inventors interrogated whether transfection of a C/EBPα-saRNA in HepG2 cells would affect expression levels of these three factors.

Figure 8A:
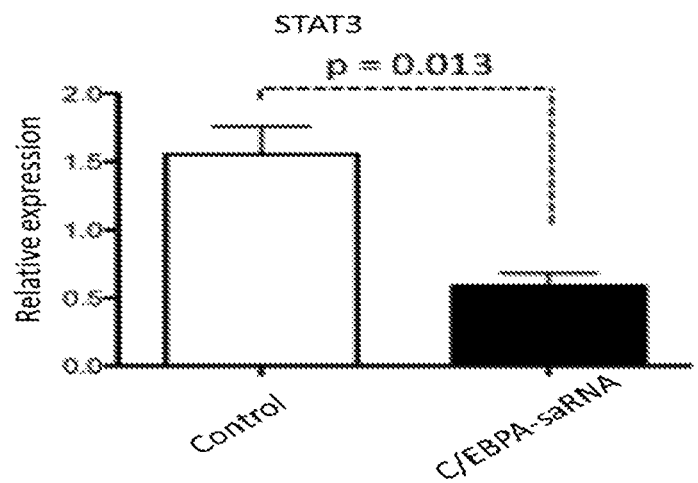
FIG. 8A-8C show identification of binding sites within promoters. A ChIP-Seq analysis of STAT3, c-Myc (MYC) and interleukin 6 receptor (IL6R) genes show the presence of C/EBPα binding sites within their promoter regions.
Figure 8B:
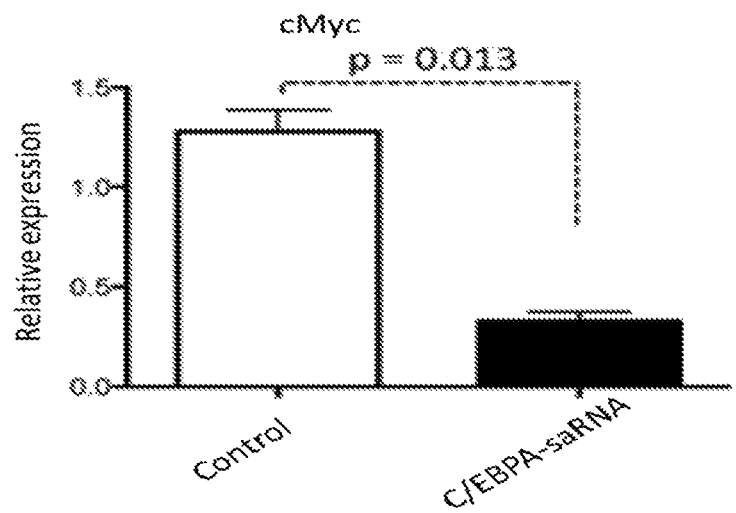
Figure 8C:
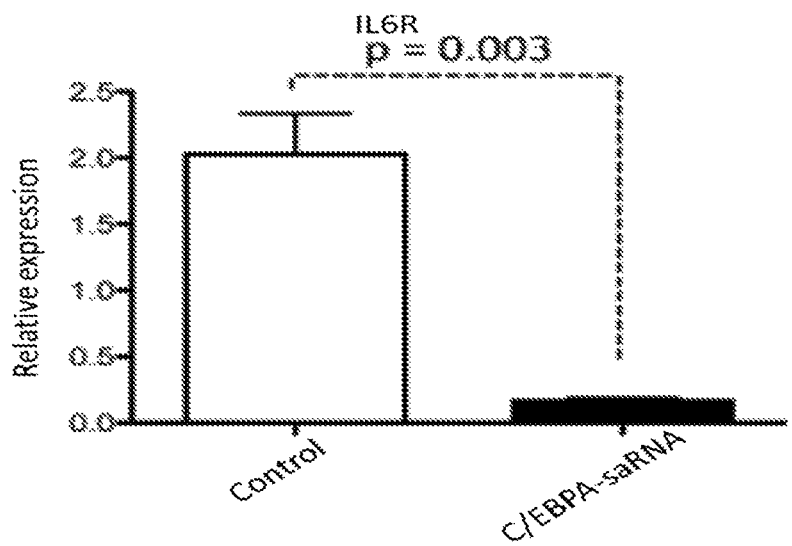
Figure 9A:
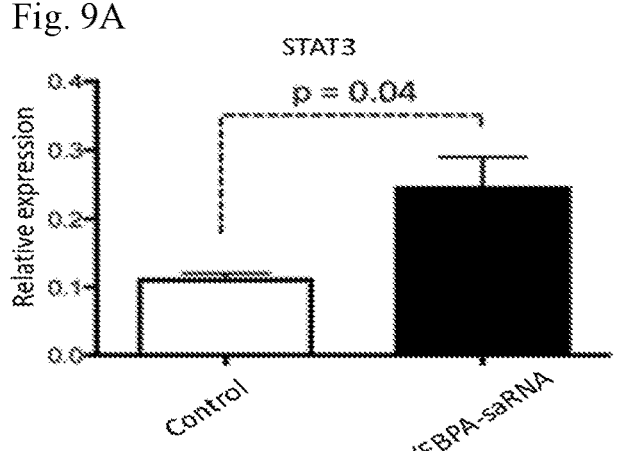
FIG. 9A-9D illustrate results of a methylaztion assay and Western blot.
Figure 9B:
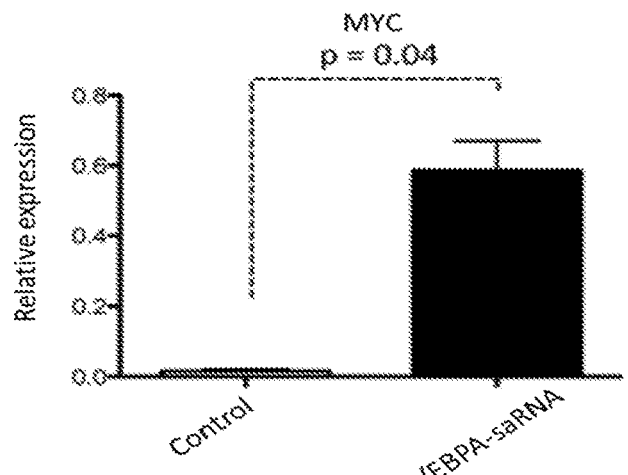
Figure 9C:
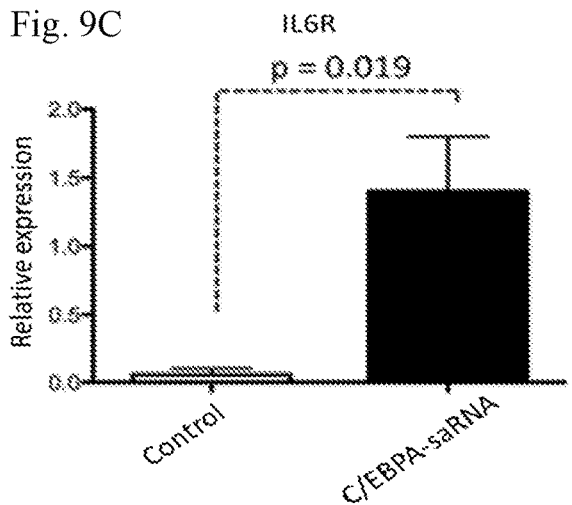
Figure 9D:
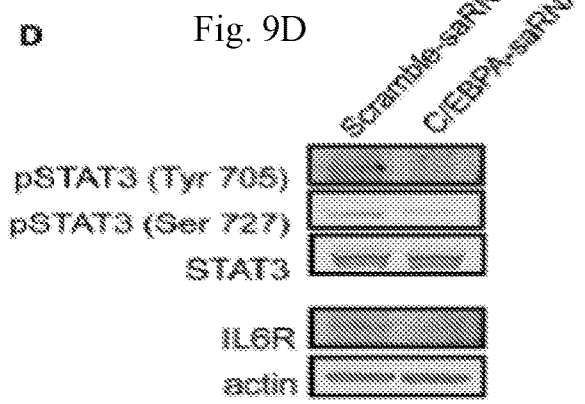

A significant reduction in mRNA levels of STAT3 (FIG. 8A), cMyc (FIG. 8B) and IL6R (FIG. 8C) was observed when compared to untransfected cells. HepG2 cells were transfected with either C/EBPα-saRNA or Scramble-saRNA at 20 nM final concentration. After three sets of transfections, cells were harvested for total RNA extraction and genomic DNA removal. Following reverse transcription of mRNA, quantitative PCR analysis was performed to detect transcript levels of STAT3, MYC and IL6R. This trend in gene reduction was also observed for MYC and STAT in our previously described gene expression array (Table 5). When the methylation status of the CpG islands at the promoter regions of STAT3 (FIG. 9A), MYC (FIG. 9B) and IL6R (FIG. 9C) were assessed using EPITECT™ Methyl II PCR assay (QIAGEN), an increase in methylation state at the promoters of all three genes was detected. A Western blot also confirmed a reduction in the phosphorylation status of STAT3 at residues 705 and 727 and in the protein level of IL6R (FIG. 9D). Collectively, it was shown that in vivo delivery of C/EBPα might have a positive effect in assisting liver function and decreasing aberrant cell proliferation in a cirrhotic/HCC setting.

In summary, the well-known anti-proliferative effects of C/EPBα were confirmed in a clinically relevant cirrhotic/HCC model. In addition to regulating known targets of C/EPBα that control cell proliferation it was demonstrated, using a liver cancer specific gene array, that C/EPBα targets numerous other oncogenes and tumor suppressor genes. Modulation of C/EPBα-saRNA therefore may have a profound effect at the transcriptional level for treating liver cancer. Currently, most therapeutic disciplines such as surgery, chemotherapy, radiotherapy and biologics are associated with variable decrease of liver dysfunction. The data presented here offer a new approach to targeting liver cancer cells.

Example 2

C/EBPα-saRNA-Dendrimer Gene Expression Analysis

C/EBPα expression in Huh7 liver cell line was tested with control, C/EBPα-saRNA alone, different dendrimers, and C/EBPα-saRNA-dendrimers with different C/EBPα-saRNA: dendrimer ratios. Clinical grade C/EBPα-saRNA was used for transfection. Results in FIG. 10 show that the C/EBPα gene expression was only increased with C/EBPα-saRNA-dendrimers.

Example 2b saRNA Dendrimer Stability

Figure 11:
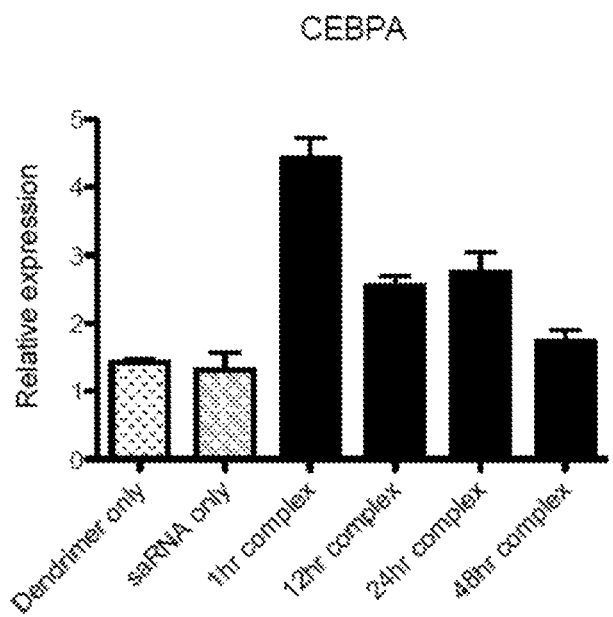
FIG. 11: C/EBPα expressions in HepG2 cells were measured with C/EBPα-saRNA-dendrimer complexes that were incubated for different periods of time.

The stability of C/EBPα-saRNA-dendrimers was also tested. C/EBPα-saRNA-dendrimers were incubated at room temperature for 1 hr, 12 hr, 24 hr and 48 hr prior to transfection to HepG2 cells. Transcript levels of C/EBPα mRNA were then measured following 3× doses of 5 nmol C/EBPα-saRNA-dendrimer at each time points as shown in FIG. 11. Optimal effect was observed at 1 hr. This is reduced by at least 50% between 12 and 24 hours. At 48 hours, C/EBPα-saRNA-dendrimers lost most of their stability.

Figure 12:
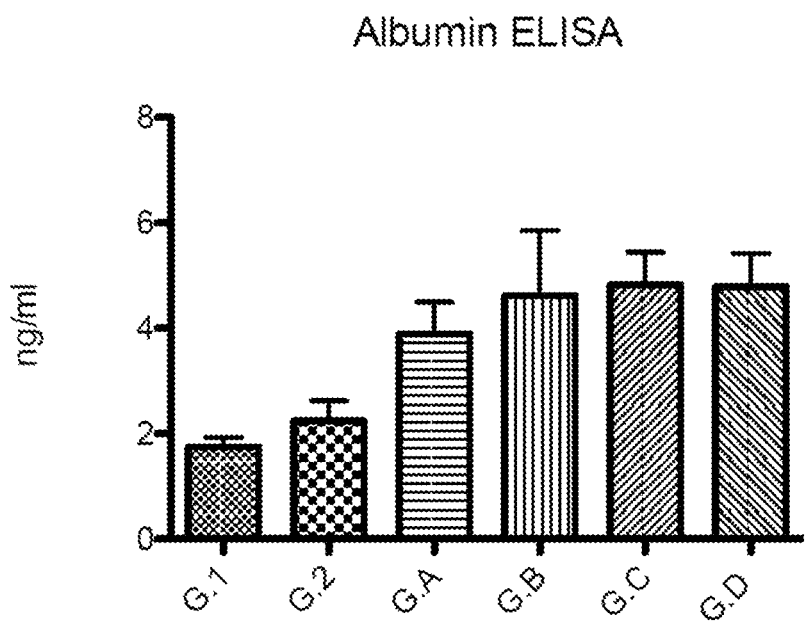
FIG. 12: Serum albumin levels in mice were tested for a week after injection of C/EBPα-saRNA-dendrimer complexes, 3× does and 100 uL per injection.
Figure 13A:
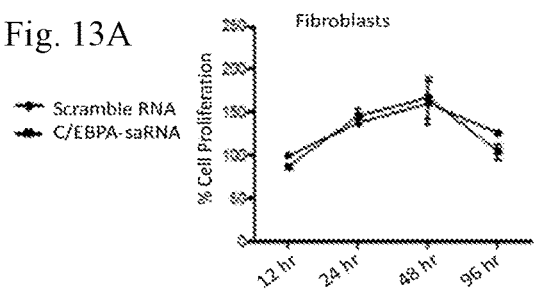
FIG. 13A-13G: Proliferation study. WST-1 cell proliferation assay results for fibroblasts (FIG. 13A), HL60 (FIG. 13B), K562 (FIG. 13C), Jurkat (FIG. 13D), U937 cells (FIG. 13E), U373 (FIG. 13F), and 32DZ10 (FIG. 13G) cells after C/EBPα-saRNA transfection.
Figure 13B:
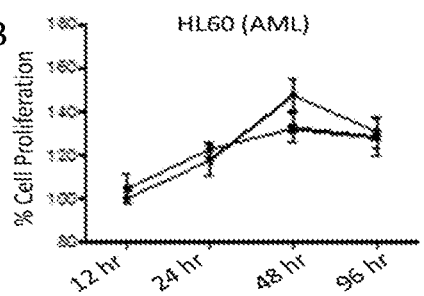
Figure 13C:
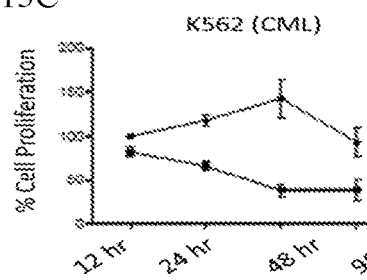
Figure 13D:
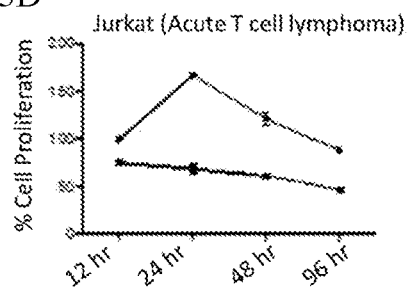
Figure 13E:
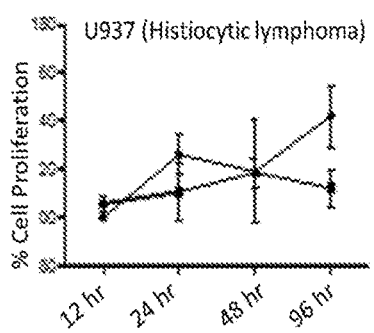
Figure 13F:
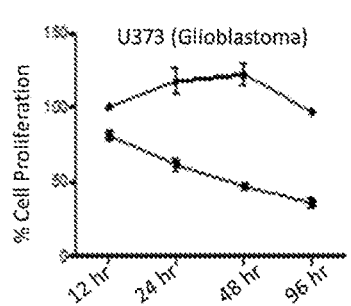
Figure 13G:
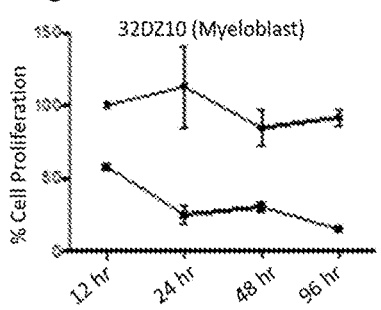

Serum albumin levels were tested for a week in mice after injection of C/EBPα-saRNA-dendrimer complexes. Results are shown in FIG. 12. Each group comprises 5 mice. Group 1 had no treatment and the serum albumin levels were tested on the first day. Group 2 had no treatment and the serum albumin levels were tested on the 8th day. Group A was treated with 3× doses of 5 nmol of C/EBPα-saRNA-dendrimers at a concentration of 0.1 nmol/uL, and the serum albumin levels were tested on the 2nd day. Group B, C, and D all were treated with the same amount of C/EBPα-saRNA-dendrimers and the serum albumin levels were tested on the $3^{rd}$, $5^{th}$ and 8th days, respectively. The serum albumin levels of Group A, B, C, and D were higher than Group 2, demonstrating that the effect of C/EBPα-saRNA-dendrimers lasted until at least the 8th day after administration.

Example 3

C/EBPα-saRNA-dendrimer Drug Targeting In Vivo in Normal Animals

To assess the biochemical effect of intravenous injection of C/EBPα-saRNA in mice in the absence of liver disease, circulating serum for liver specific factors was analyzed and histopathological changes in hepatocytes of C/EBPα-saRNA injected mice v.s. control mice were studied.

Ten Male C57Bl6/J, 8 week old mice were used for the experiment (Control group N=5). Approval was obtained from Institutional and Regional Regulatory bodies and all procedures were in compliance with standing National Regulations. 5 nmol of C/EBPα-saRNA at a concentration of 0.1 nmol/uL was reconstituted to a total volume of 100 uL with RNase/Dnase free $H_2O$. 50 uL of complex A (C/EBPα-saRNA) and 50 uL of complex B (INVIVOFECTAMINE, INVITROGEN, CA, USA) were mixed, incubated at 50° C. for 30 minutes and the resulting mixture was used for tail vein injections. Control animals were injected with equal volume of PBS while a positive control animal received siRNA against Factor VII; a total of 5 control and 5 experimental animals were injected.

In the absence of liver disease, injection of C/EBPα-saRNA caused a significant increase in circulating levels of albumin and unconjugated bilirubin levels indicating increased liver function. Serum levels of alanine transaminase (ALT), aspartate aminotransferase (AST) and gamma glutamyl transpeptidase (GGT) decreased in C/EBPα-saRNA injected mice.

Pathological examination of liver biopsies stained with hematoxylin and eosin was conducted. No discernible or prominent morphological differences between the control and treated group were observed. In general, the architecture of the liver acini was preserved. There was no significant portal inflammation or fibrosis following injection of C/EBPα-saRNA. The bile ducts appeared normal in both groups and there were no trace of foci or oval cell proliferation or foci of hepatic necroinflammatory activity.

The central venules and sinusoids appeared normal in both groups. There were no morphological evidence to suggest that Kuppfer cells were activated nor were there signs of vascular or endothelial alterations. There were no visible evidence of cell injury including ballooning and steatosis. There were no findings suggestive of increased hepatocellular proliferation (mitoses, thickened plates or nuclear crowding). One consistent observation, however, was the more compact and slightly more basophilic cytoplasm in the zone 1 of the C/EBPα-saRNA treated group. Zone 1 is regarded as an area preferential for albumin synthesis in the liver.

Example 4

C/EBPα-saRNA-dendrimer Acute Toxicity Study

The effect of increasing the concentration of C/EBPα-saRNA-dendrimers injections to animals was studied.

The study was performed in the animal facility of the Center for Experimental Surgery of the Biomedical Research Foundation of the Academy of Athens and was evaluated and authorized by the Veterinary Service of the Prefecture of Athens (permit no. 414/07-02-2013), as required by the Greek legal requirements for animal experimentation.

Animals

Thirty one male Wistar outbred rats (HsdOla:WI), bred in the animal facility of the Center from animals purchased from Harlan Laboratories (Blackthorn, UK) with a mean body weight 303.3±28.5 g (mean±1 SD) and aged 12-14 weeks old, were used in the study. The animals were kept under standard conditions, fed standard rat food (Teklad 2918, Harlan, Udine, Italy) and given tap water ad libitum according to the Guide for the Care and Use of Laboratory Animals and the relevant recommendations of the European Commission on the care and use of laboratory animals.

All rats in the facility were screened regularly by using a health monitoring program, in accordance to the Federation of European Laboratory Animal Science Associations' recommendations, and were free from a wide range of pathogens including Kilham rat virus, rat parvovirus, Toolan H1 virus, Sendai virus, pneumonia virus of mice, reovirus type III, murine encephalomyelitis virus, sialodacryoadenitis virus, rat minute virus, Hantaan virus, lymphocytic choriomeningitis virus, cilia-associated respiratory *bacillus*, mouse adenovirus types 1 and 2, rat rotavirus, rat coronavirus, *Mycoplasma pulmonis, Clostridium piliforme, Bordetella bronchiseptica, Pasteurella* spp., fur mites, and pinworms.

Methods

Animals were randomized into four groups, consisting of 10 animals for the control group (group C) and 7 animals for all the other groups. In the control group, 100 µL of PBS was administered in animals via the tail vein. Dosing solutions of 100 µL of standard, 2× and 3× of C/EBPα-saRNA-dendrimers at a concentration of 0.1 nmol/uL in PBS were administered in animals of group 1×, 2× and 3× respectively. Injections were repeated every other day for three consecutive times.

Body weight of the animals was measured at the beginning and the end of the procedure just before the euthanasia.

Three days after the last C/EBPα-saRNA-dendrimer injection the rats were anesthetized using an inhalation anesthetic (isoflurane) and blood was collected from caudal vena cava.

Blood Assays 3 ml of blood sample were collected in tubes for the measurement of gamma-glutamyl transpeptidase (GGT), serum glutamic-oxaloacetic transaminase (SGOT), serum glutamic-pyruvic transaminase (SGPT), alkaline phosphatase (ALP), total bilirubin, direct bilirubin, creatinine, urea, albumin and total cholesterol serum levels at the end of each group experimental period. The collected blood was centrifuged at 3000 rpm for 10 min and the serum was analyzed in a biochemical analyzer (Chemwell 2910, Awareness Technology Inc., Palm City, Fla., USA) by enzymatic colorimetric methods using commercial kits (Human, Germany).

Another 3 ml of blood samples were collected in tubes for hematological analysis using an hematology analyzer (MEK 6318, Nihon-Kohden, Tokyo, Japan).

Histological Analysis

At necropsy liver, spleen and kidney from each animal were collected and fixed in 10% formalin. Following fixation, specimens were processed routinely (dehydration through graded ethanol solutions and clearance in xylene solution), embedded in paraffin, sectioned at 5 µm and stained with Hematoxylin-Eosin (H-E).

Statistical Analysis

GraphPad Prism for Windows was used for the statistical analyses. One-way analysis of variance and Bonferroni's multiple comparison test were used to compare the differences from the administration of different doses of C/EBPα-saRNA-dendrimers. All variables are expressed as mean±SD. Values of $p<0.01$ were considered to indicate statistical significance.

Results

There was no mortality caused during the injections of the solution. No alteration of body weight or cholesterol was noticed among groups. Treatment of the animals with doses of 100 uL, 200 uL and 300 uL of 0.1 nmol/uL C/EBPα-saRNA-dendrimer did not have any influence on haemogloblin (Hb) levels (normal range 16 g/dL). Treatment with increasing dose of C/EBPα-saRNA-dendrimer did not alter white blood cell (WBC) count away from values in the control group. Treatment with increasing dose of C/EBPα-saRNA-dendrimer did not alter blood platelet count away from the control group. Treatment with the highest dose (3× doses) did however show reversion of platelet counts closer to 'normal range' as defined by Harlan Laboratory parameters.

Biochemical analysis for liver function revealed that gamma glutamyl transpeptidase (GGT) levels from C/EBPα-saRNA-dendrimer treated groups at all dose levels were closer to the normal range (as defined by Harlan parameters) when compared to control. This suggests an improvement in liver function within the treated groups. Serum glutamic oxaloacetic transaminase (SGOT) or aspartate transaminase (AST) levels showed no changes in the treated groups relative to the control group. Serum glutamic pyruvate transaminase (SGPT) or alanine transaminase (ALT) levels were closer to the normal range in 1× and 2× C/EBPα-saRNA-dendrimer treated animals. Levels in the 3× C/EBPα-saRNA-dendrimer treated group were comparable to the control group. Circulating levels of alkaline phosphatase (ALP) showed no differences between control and treated groups. Circulating levels of unconjugated bilirubin in the treated animals did not alter away from the normal range. Urea and creatinine levels were used to evaluate kidney function. No changes were observed between control and treated animals.

Therefore, the data show that C/EBPα-saRNA-dendrimer molecules can positively regulate liver function with no evidence of associated toxicity.

Administration of C/EBPα-saRNA-dendrimer increasing dose from 1× to 3× did not impact on liver, spleen or kidney histological appearance, either. Liver specimens collected from animals of the 1×, 2× or 3× group did not present altered cytoarchitecture when compared with the control group. Lobular architecture could not be clearly observed due to smaller liver size and decreased amount of connective tissue (species characteristic). Apart from a mild hyperemia however, there were no other lesions (such as fatty infiltration, inflammation or necrosis) observed.

Kidney histology did not present changes between experimental and control groups. All specimens presented normal renal corpuscles and typical proximal and distant tubule epithelial lining. No inflammatory or degenerative lesions were observed except for a mild hyperemia (like the liver specimens) both in glomerular and peritubular capillaries and interlobular vessels.

Spleen microscopic evaluation (just as liver and kidney) did not show abnormal tissue architecture. All groups presented normal white pulp with easily observable lymphatic nodules and periarterial lymphatic sheaths. All animals however presented hyperemic red pulp. Hyperemia is present even close to the germinal centers of splenic nodules (aka marginal zone). Additionally, large vessels were filled with red blood cells indicating overall splenic congestion.

The data support an overall profile of safety and efficacy of C/EBPα-saRNA in the treatment of patients with liver failure with or without liver cancer.

Example 5

Cell Proliferation Assays of Cancer Cells Treated with C/EBPα-saRNA

Figure 14:
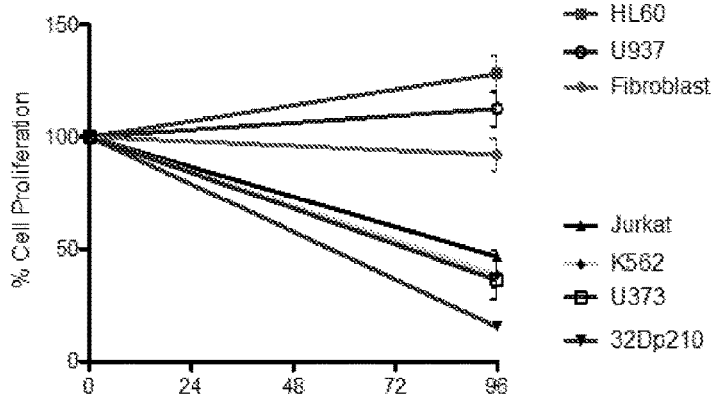
FIG. 14: Cell proliferation of HL60, U937, fibroblast, Jurkat, K562, U373, 32Dp210 cells after C/EBPα-saRNA transfection.

C/EBPα-saRNA was tested on a panel of cell lines representing well-differentiated and undifferentiated cancer types. WST-1 cell proliferation assays were performed on fibroblasts, HL60 (acute myeloid leukemia (AML)). K562 (chronic myeloid leukemia (CML)), Jurkat (acute T cell lymphoma), U937 (histiocytic lymphoma), U373 (glioblastoma), 32DZ210 (myeloid leukemia) shown in FIG. 13, and HepG2 (human HCC), rat liver cancer cells, Panc1 (human pancreatic epitheloid carcinoma), MCF7 (human breast adenocarcinoma), DU145 (human metastatic prostate cancer), and MIN6 (rat insulinoma) shown in FIG. 15. These cells were treated with 20 nM of C/EBPα-saRNA in 3× doses at 2 hr, 48 hr, and 72 hr. Cell proliferation was measured and the results are shown in FIGS. 14 and 16. The results demonstrate excellent inhibition of 32Dp210 (myeloid leukemia), U373 (glioblastoma), K562 (CML), Jurkat (acute T cell lymphoma), DU145 (human metastatic prostate cancer), panel (human pancreatic carcinoma), rat liver cancer cells, HepG2, and MCF7 (human breast cancer).

The involvement of C/EBPα-saRNA in ovarian cancer was tested on cisplatin-sensitive PEO1 cells and cisplatin-resistant poorly-differentiated PEO4 cells. PEO1 and PEO4 cells are in vivo derived isogenic cell line pairs. Cells were seeded and transfected three times with 20 nM C/EBPα-saRNA and scramble saRNA control. WST-1 assay was performed at 16 h, 24 h, 48 h, 72 h, and 96 h. C/EBPα-saRNA decreases the cell survival in both cisplatin-sensitive (PEO1) and resistant (PEO4) ovarian cancer cells.

In addition, WST-1 cell proliferation assays demonstrated inhibition of small cell lung carcinomas and pancreatic adenocarcinomas when compared to treatment with scramble saRNA controls. In contrast, C/EBPα-saRNA was not, however, as effective in suppressing proliferation in well-differentiated rat insulinoma. C/EBPα-saRNA only reduced the proliferation of well-differentiated breast cancer (MCF7) cell lines for 31%. Comparison of endogenous levels of C/EBPα using qPCR and Western blots showed that undifferentiated tumor cell lines expressed lower levels when compared to well-differentiated lines. Data not shown here.

The results presented here suggest that C/EBPα-saRNA could be an important factor for treating tumors of various degrees of differentiation. Furthermore, it could potentially be used to select patients that could benefit from this novel therapy.

Example 6

C/EBPα-saRNA and C/EBPβ-siRNA Combinations in Treating Tumors

In this study, a CEBPα-saRNA of the present invention was administered with an siRNA that inhibits C/EBPβ gene expression. HepG2 cell proliferation and MCF7 cell proliferation were quantified at 16, 24, 48, 72, 96 and 120 hours, respectively, following C/EBPα-saRNA+C/EBPβ-siRNA transfection by mitochondrial dehydrogenase expression analysis, using WST-1 reagent following the manufacturer's guideline. Cell proliferation with 20 nM scramble siRNA, 50 nM scramble saRNA, 20 nM scramble siRNA+50 nM scramble saRNA, 20 nM C/EBPβ-siRNA alone, and 50 nM C/EBPα-saRNA alone were also tested. For HepG2 cells, C/EBPα-saRNA alone and C/EBPα-saRNA+C/EBPβ-siRNA both inhibit tumor cell proliferation. For MCF7 cells, C/EBPα-saRNA+C/EBPβ-siRNA reduced cell proliferation by 50% at 120 hr. Therefore, C/EBPα-saRNA combined with C/EBPβ-siRNA is a promising therapeutic agent for treating HCC and breast cancer.

Example 7

C/EBPα-saRNA Regulates miRNA Levels

The correlation between miRNAs and progression and prognosis of cancer has recently been evaluated in several studies. For HCC, some miRNAs have been extensively studied since their initial discovery (e.g., miR-21 or miR-122). However a huge number of miRNAs are actually implicated in cancer development and progression. miRNAs and cancer are strongly related and they might be used for specific gene therapy of cancer. The aim of this study was to evaluate the potential anticancer effect of C/EBPα-saRNA by regulation of miRNA expression.

HepG2 cells were cultured and treated with 20 nM final concentration of C/EBPα-saRNA. miRNA expression levels were detected by microarray and verified by Real-time-PCR in both groups. For animal experiments, a clinically relevant rat liver tumor model was used and animals were treated with 0.1 nmol/uL of C/EBPα-saRNA-dendrimers via tail vein injections. Control animals were injected with equal volumes of PBS or scramble-saRNA.

The experimental procedures conducted in the present study are described below.

The two strands of the C/EBPα-saRNA were annealed using 50 mM Tris-HCl, pH8.0, 100 mM NaCl and 5 mM EDTA following a denaturation step at 90° C. followed by a gradual anneal step to room temperature. C/EBPα-saRNA was transfected into HepG2 and rat liver epithelial cell lines and total RNAs were isolated form cell.

Isolation of Mature miRNA from Cell Lines

Cell pellets were lysed using a phenol/guanidine based lysis buffer and separated into aqueous and organic phase using chloroform. The miRNA-enriched fraction was then separated from the total RNA following the manufacturer's protocol (miRNeasy MiniKit, QIAGEN, Germantown, Md.).

Mature miRNA Microarray Profile

The Human Cancer PATHWAYFINDER MISCRIPT™ miRNA PCR array (QIAGEN/SA BIOSCIENCES-MIHS102ZA) was used to profile the expression of 84 miRNAs differentially expressed in tumors versus normal tissues. 500 ng of purified RNA was reverse transcribed for 15 minutes with MISCRIPT® RT2 kit (QIAGEN) using MISCRIPT HISPEC Buffer (QIAGEN) for efficient reverse transcription of small nucleolar RNAs (snoRNAs) and small nuclear RNAs (snRNAs). The cDNA was then transferred into the miScript miRNA PCR array plates for amplification in a 7900HT Applied Biosystems Real Time cycler using miScript Universal Primer (QIAGEN) and QuantiTect SYBR Green PCR Master Mix (QIAGEN) at 1 cycle for 10 min at 95° C. and 40 cycles (15 secs at 95° C. and 1 min at 60° C.) for fluorescence data collection.

The threshold cycle for each well was manually calculated and exported for data analysis and clustering using SABiosciences array specific Data Analysis Software (QIAGEN, Germantown, Md.) Gene Ontology (GO) Enrichment Analyses The database for annotation, visualization and integrated discovery (DAVID, NIAID, NIH, Bethesda, Md.) tool was used to identify functional categories significantly enriched among up-regulated and down-regulated genes.

MicroRNA Target Analyses

TARGETSCAN total context score prediction data were downloaded from the TARGETSCAN website [Grimson et al., *Cell Press*, vol. 27, 91-105 (2007), the contents of which are incorporated herein by reference in their entirety]. For each gene in the TARGETSCAN database, the total sum of context scores for all up-regulated miRNAs was computed. Similarly, for each gene, the total sum of context scores for all down-regulated miRNAs was computed. Finally, for a given gene, the predicted contribution of the up-regulated miRNAs compared with the down-regulated miRNAs was the gene's rank in the sum context scores distribution for the up-regulated miRNAs minus the gene's rank in the sum context scores distribution for the down-regulated miRNAs. Genes that had and absolute change in their relative rank by more than 0.4 were considered to be strongly affected by the up-regulated or down-regulated miRNAs.

Results

Cancer miRNA Analysis Suggests C/EBPα-saRNA Mediated Deregulation of miRNAs Involved in Liver Cancer.

To study the potential contribution of aberrant miRNA regulation in C/EBPα-saRNA transfected cells, the expression of 84 cancer specific mature miRNAs was profiled.

The expression pattern varied greatly between treated and untreated cells. Overall tumor suppressor miRNAs were upregulated whilst oncogenic miRNAs were suppressed (Table 9).

miRNA target predictions indicated that most of the differentially expressed mRNAs identified were regulated by several of the differentially expressed miRNAs. To identify which of the mRNAs were most likely to be affected by the altered miRNA expression, mRNAs that were predicted to be most strongly targeted by up-regulated miRNAs compared with the down-regulated miRNAs were identified. One down-regulated (BIRC2) and three up-regulated (RUNX3, PTK2, FHIT) genes were predicted to be the most affected by the down-regulated miRNAs. In contrast, four down-regulated genes (BIRC5, CCL5, CDKN2A, FADD and RAC1) were predicted to be the most affected by the up-regulated miRNAs, which included miR-122 (BIRC5 and CCL5) and miR-134 (CDKN2A and FADD). miR-122 is a liver specific miRNA known to modulate lipid metabolism, hepatitis C virus replication and inhibit apoptosis. miR122 is normally detected during liver specialization into the adult liver. The loss of miR-122 expression is implicated in promoting intrahepatic metastasis of liver tumors where its ectopic restoration has significant effects in reducing cell migration, invasion and in vivo tumorigenesis.

Since miR-122 is normally repressed in HCC, it was of note that its expression increased following transfection of C/EBPα-saRNA in HepG2 cells (Table 10). miR-122 negatively regulates multiple target genes including A-Distintegrin and A-Metalloproteinase 17 (ADAM17). Increased expression of ADAM17 plays a key role in the development of HCC. Transcription profiling analysis showed that ADAM17 was repressed in C/EBPα-saRNA transfected HepG2 cells. This has important implications for the molecular pathology of cancer cells as ADAM17 cleaves membrane tethered receptors involved in controlling cellular proliferation, migration and apoptosis. Therefore, results suggest that C/EBPα-saRNA may regulate cell proliferation, migration and apoptosis through regulating miRNA-122.

miR-134 was also up-regulated following transfection of C/EBPα-saRNA. miR-134 has previously been reported as being modulated by members of the p53/p73/p63 family as part of a miRNA tumor suppressor network. Functional studies in non-small cell lung carcinoma demonstrated that increased levels of miR-134 inhibit epithelial to mesenchymal transition (EMT). [Bloominathan, *PLoS One*, vol. 5, e10615 (2010), the contents of which are incorporated herein by reference in their entirety] A recent study has demonstrated that miR-134 exerts a dramatically suppressive effect on HCC malignancy by downregulating the onco-protein KRAS. miR-134 markedly diminished HCC tumorigenicity and displayed a significant antitumor effect in vivo. In addition, inhibition of endogenous miR-134 partially reversed the suppressive effects of HNF4α on KRAS expression and HCC malignancy. Although the function of miR-134 or its target has yet to be completely elucidated in HCC, the reduced levels of HGF and SMAD7 transcripts, genes associated with EMT, provide a plausible mechanism of action for the detected therapeutic potential of C/EBPα-saRNA.

C/EBPα-saRNA Controlled miRNAs Involved in Cell Differentiation and Proliferation In HCC, several miRNAs have been shown to be involved in the gain of anti-apoptotic properties of cancer cells. miR-100, miR-122, miR-134 and miR-140-5p are normally downregulated in HCC; they control cell growth and cell proliferation. Additionally, miR-122 and miR-140-5p have been reported to regulate hepatocytic differentiation. It has been determined here that C/EBPα induces expression of these pro-apoptotic miRNAs in HepG2 treated cells.

miR-372 functions as an oncogene in HCC since it promotes cell proliferation, invasion and migration. In the present studies, miR-372 was downregulated by C/EBPα-saRNA.

Contrary to published results, it was found that miR-125b was downregulated by C/EBPα-saRNA, while it has been reported in previous studies that it might suppress cell growth and its high expression might correlated to longer survival of HCC patients.

C/EBPα-saRNA Regulated microRNAs Involved in the Epithelial-Mesenchymal Transition of Cancer Cells.

miR-124 has been reported to inhibit epithelial mesenchymal transition (EMT). EMT-like event during tumor progression and malignant transformation confers the incipient cancer cells with invasive and metastatic properties. miR-124 is normally downregulated in HCC. It was found herein that miR-124 is up-regulated by C/EBPα-saRNA.

Further, it was found that miR-191 was up-regulated by C/EBPα-saRNA, while miR-148a was down-regulated by C/EBPα-saRNA. However, it has been reported in the literature that miR-191 is up-regulated in HCC and induces EMT, whilst miR-148a is downregulated in HCC, controlling differentiation and inhibiting EMT. Therefore, results suggest that C/EBPα-saRNA may be able to regulate EMT of cancer cells through regulating miR-124 and miR-191.

C/EBPα-saRNA Regulated miRNAs Involved in the Metastatic Process

The metastatic process arises from invasion of cancer cells into the circulation. Different miRNAs control in normal cells or promote in cancer cell motility, invasiveness and metastasis. It has been shown here that a C/EBPα-saRNA had a positive effect on most miRNAs involved in the metastatic process. C/EBPα-saRNA restored miRNAs able to inhibit invasiveness of cancer cells (miR-23b, miR-100, miR-122, miR-140-5p, let-7g) and suppressed the levels of pro-metastatic miRNAs (miR-17-5p, miR-21, miR-372). (Table 9) On the other hand, it was found that miR-10b was upregulated in HepG2 treated cells. It has been reported in the literature that it is normally upregulated in HCC and its expression correlates with poor prognosis and short survival of HCC patients.

Discussion

The present studies revealed that 42 miRNAs were upregulated by C/EBPα-saRNA in treated HepG2 cells, acting as tumor suppressors. On the other hand, 34 miRNAs act as oncogenes as they were downregulated by C/EBPα-saRNA in treated HepG2 cells. It was also found that 8 miRNAs were not influenced by injection of C/EBPα-saRNA. The results confirmed that multiple miRNAs are involved in HCC.

miR-134 showed positive regulation following C/EPBα-saRNA transfection. This miRNA functions as part of a tumor suppressor network where it prevents epithelial to mesenchymal transition (EMT) of cancer cells. The increased expression of miR-134 following C/EBPα-saRNA transfection suggests another important contributor to the effect of C/EPBα-saRNA where multiple genes involved in EMT transition (HGF, SMAD7, and to a lesser extent, CTNNB1) were repressed.

Expression of miR-23b also increased in the C/EPBα-saRNA transfected cells. miR-23b is normally downregulated in HCC leading to upregulation of urokinase-type plasminogen activator (uPA) and c-Met, thus increasing cell migration and proliferation. Increased levels of let7g were also seen following C/EPBα-saRNA transfection of HepG2 cells. Let7g expression is normally lost during metastatic progression of HCC.

Loss of miR-21 in C/EPBα-saRNA transfected HepG2 cells is also of note as previous reports suggest its gain of function is seen in HCC tumors and cell lines. Suppression of miR-21 is thought to enhance phosphatase and tensin homologue (PTEN) tumor suppressor activity.

A number of miRNAs, such as miR-215 or miR-193, that were found to be affected by C/EBPα-saRNA in treated cells, have not been previously reported to be involved in HCC.

The findings of the inventors disagree with the literature concerning 4 miRNAs that were found to be influenced by C/EBPα-saRNA in comparison to not treated HepG2 cells. (i.e. miR-10b, miR-125b, miR-148a and miR-191).

In conclusion, C/EBPα-saRNA clearly regulates the expression of miRNAs. The understanding provided herein regarding miRNA involvement and function in HCC as well as in other cancers supports the use of miRNAs not only as prognostic factors, but also underscores their potential role in diagnosis, staging and treatment of cancer.

TABLE 9

Summary of miRNAs that are up-regulated (Top), unchanged (middle), and down-regulated (bottom) in C/EBPα-saRNA treated HepG2 cells.

| miRNA upregulated | | |
|---|---|---|
| Mature miRNA | SEQ ID | Fold Regulation |
| hsa-let-7a-5p | 119 | 2.1059 |
| hsa-miR-133b | 120 | 1.434 |
| hsa-miR-122-5p | 121 | 1.5369 |
| hsa-miR-335-5p | 122 | 1.165 |
| hsa-miR-196a-5p | 123 | 1.434 |
| hsa-miR-142-5p | 124 | 1.434 |
| hsa-miR-96-5p | 125 | 1.0979 |
| hsa-miR-184 | 126 | 1.434 |
| hsa-miR-214-3p | 127 | 2.1278 |
| hsa-miR-15a-5p | 128 | 1.6102 |
| hsa-let-7b-5p | 129 | 1.9416 |
| hsa-miR-205-5p | 130 | 1.2197 |
| hsa-miR-181a-5p | 131 | 1.8834 |
| hsa-miR-140-5p | 132 | 1.0625 |
| hsa-miR-146b-5p | 133 | 1.2762 |
| hsa-miR-34c-5p | 134 | 1.434 |
| hsa-miR-134 | 135 | 4.3932 |
| hsa-let-7g-5p | 136 | 1.0784 |
| hsa-let-7c | 137 | 1.5508 |
| hsa-miR-218-5p | 138 | 1.434 |
| hsa-miR-206 | 139 | 1.434 |
| hsa-miR-124-3p | 140 | 3.4534 |
| hsa-miR-100-5p | 141 | 1.4176 |
| hsa-miR-10b-5p | 142 | 1.434 |
| hsa-miR-155-5p | 143 | 1.434 |
| hsa-miR-1 | 144 | 2.3958 |
| hsa-miR-150-5p | 145 | 1.3919 |
| hsa-let-7i-5p | 146 | 1.3141 |
| hsa-miR-27b-3p | 147 | 1.1952 |

TABLE 9-continued

Summary of miRNAs that are up-regulated (Top), unchanged (middle), and down-regulated (bottom) in C/EBPα-saRNA treated HepG2 cells.

| hsa-miR-127-5p | 148 | 2.2593 |
|---|---|---|
| hsa-miR-191-5p | 149 | 1.4119 |
| hsa-let-7f-5p | 150 | 1.1629 |
| hsa-miR-10a-5p | 151 | 1.434 |
| hsa-miR-15b-5p | 152 | 1.9513 |
| hsa-miR-16-5p | 153 | 2.2248 |
| hsa-miR-34a-5p | 154 | 1.0544 |
| hsa-miR-144-3p | 155 | 1.434 |
| hsa-miR-128 | 156 | 1.2021 |
| hsa-miR-215 | 157 | 1.1017 |
| hsa-miR-193a-5p | 158 | 1.1689 |
| hsa-miR-23b-3p | 159 | 1.2428 |
| hsa-miR-203a | 160 | 1.434 |

| miRNA-remain unchanged | | |
|---|---|---|
| Mature miRNA | SEQ ID | Fold Regulation |
| hsa-miR-30c-5p | 161 | 1.051869 |
| hsa-let-7c-5p | 162 | 0.058758 |
| hsa-miR-146a-5p | 163 | 0.33665 |
| hsa-let-7d-5p | 164 | 0.016391 |
| hsa-miR-9-5p | 165 | 0.000384 |
| hsa-miR-181b-5p | 166 | 0.013964 |
| hsa-miR-181c-5p | 167 | 0.028291 |

| miRNA-downregulated | | |
|---|---|---|
| Mature miRNA | SEQ ID | Fold regulation |
| hsa-miR-20b-5p | 168 | −1.3359 |
| hsa-miR-125a-5p | 169 | −1.2372 |
| hsa-miR-148b-3p | 170 | −1.2082 |
| hsa-miR-92a-3p | 171 | −1.3741 |
| hsa-miR-378a-3p | 172 | −1.2451 |
| hsa-miR-130a-3p | 173 | −1.6427 |
| hsa-miR-20a-5p | 174 | −1.2847 |
| hsa-miR-132-3p | 175 | −1.3606 |
| hsa-miR-193b-3p | 176 | −1.3868 |
| hsa-miR-183-5p | 177 | −1.1387 |
| hsa-miR-148a-3p | 178 | −1.3625 |
| hsa-miR-138-5p | 179 | −1.7459 |
| hsa-miR-373-3p | 180 | −1.4128 |
| hsa-miR-29b-3p | 181 | −1.5059 |
| hsa-miR-135b-5p | 182 | −1.1296 |
| hsa-miR-21-5p | 183 | −1.1023 |
| hsa-miR-181d | 184 | −2.5603 |
| hsa-miR-301a-3p | 185 | −1.1637 |
| hsa-miR-200c-3p | 186 | −1.0718 |
| hsa-miR-7-5p | 187 | −1.2395 |
| hsa-miR-29a-3p | 188 | −1.2202 |
| hsa-miR-210 | 189 | −1.8605 |
| hsa-miR-17-5p | 190 | −1.1816 |
| hsa-miR-98-5p | 191 | −1.3495 |
| hsa-miR-25-3p | 192 | −1.1599 |
| hsa-miR-143-3p | 193 | −1.1295 |
| hsa-miR-19a-3p | 194 | −2.2794 |
| hsa-miR-18a-5p | 195 | −1.2477 |
| hsa-miR-125b-5p | 196 | −2.3555 |
| hsa-miR-126-3p | 197 | −2.793 |
| hsa-miR-27a-3p | 198 | −1.4998 |
| hsa-miR-372 | 199 | −1.7218 |
| hsa-miR-149-5p | 200 | −2.1206 |
| hsa-miR-32-5p | 201 | −1.5235 |

TABLE 10

11 miRNAs known to be involved in pathogenesis of liver cancer. The top 7 are down-regulated mature miRNAs in C/EBPα-saRNA treated cells and the bottom 4 are up-regulated miRNAs.

| miRNA | Clinical significance in HCC | Target | C/EPBα-saRNA | Fold Regulation |
|---|---|---|---|---|
| hsa-miR-25-3p | No previous reports in the literature for HCC | — | — | −1.1599 |
| hsa-miR-125b-5p | High expression correlated to longer survival Downregulated in HCC | PI3K/Akt/mTOR signal pathway | Down | −2.3555 |
| hsa-miR-126-3p | No previous reports matching our criteria in the literature | — | — | −2.793 |
| hsa-miR-130a-3p | Overexpression correlates to chemoresistance Upregulated in HCC | RUNX3 Wnt signaling | Down | −1.6427 |
| hsa-miR-17-5p | Tumor aggressiveness; poor prognosis and survival Upregulated in HCC | — | Down | −1.1816 |
| hsa-miR-21-5p | Tumor aggressiveness and poor prognosis Upregulated in HCC | PTEN RECK PDCD4 | Down | −1.1023 |
| hsa-miR-193b-3p | No previous reports in the literature for HCC | — | — | −1.3868 |
| hsa-miR-191-5p | Poor prognosis Upregulated in HCC | TIMP3 | Up | 1.4119 |
| hsa-miR-215 | No previous reports in the literature for HCC | — | — | 1.1017 |
| hsa-miR-23b-3p | Tumor dissemination Downregulated in HCC | UPCA C-MET | Up | 1.2428 |
| hsa-miR-122-5p | Cancer progression Poor prognosis Downregulated in HCC | ADAM17 | Up | 1.5369 |

Example 8

Figure 17A:
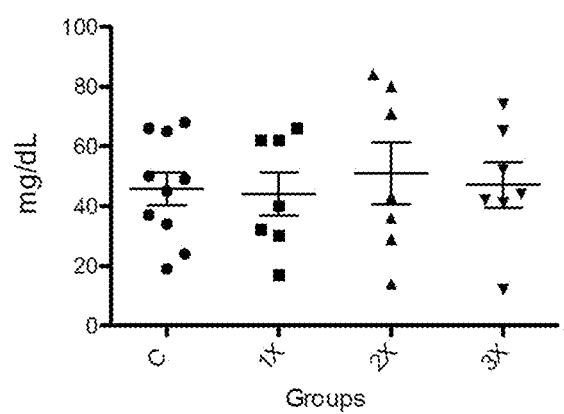
FIG. 17A-17B: Effects on cholesterol.
Figure 17B:
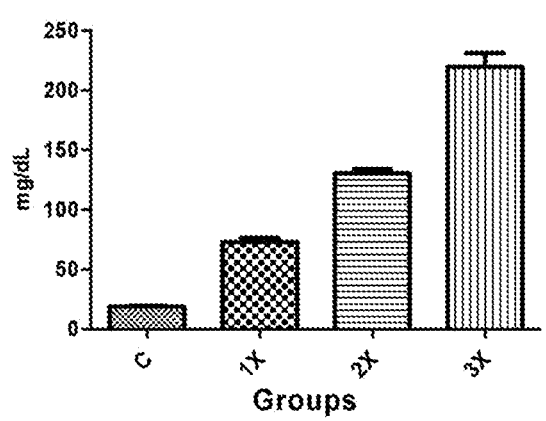

C/EBPα-saRNA Regulates Cholesterol and LDL Levels, Insulin Resistance Genes, Treats Non-alcoholic Fatty Liver Disease, Insulin Resistance, and Steatosis, and Regulates Metabolic Genes in BAT and WAT C/EBPα-saRNA-dendrimers of the present invention was administered to mice in 0.1 nmol/uL standard dose, 2× doses, and 3× doses. LDL levels in blood were measured. Dose increase of C/EBPα-saRNA altered circulating levels of cholesterol (FIG. 17A) and LDL (FIG. 17B). The data show LDL circulating levels increased, indicating that LDL levels inside liver cells have decreased.

Further, studies were conducted to test C/EBPα-saRNA as a treatment for non-alcoholic fatty liver disease (NAFLD) in vivo. Rats were treated with high fat diet for 4 weeks to induce NAFLD. C/EBPα-saRNA was reconstituted with 100 ul of TEA-core PAMAM dendrimer to a concentration of 0.1 nmol/uL C/EBPα-saRNA-dendrimers. Rats with NAFLD were treated with 3× doses of C/EBPα-saRNA (R) carried by dendrimers (R+D) via tail vein injections for seven days. The rats with NAFLD in the control group were treated with PBS buffer (PBS), C/EBPα-saRNA alone (R), dendrimers alone (D), oral ezetimibe alone (E), scrambled saRNA (Sc) with dendrimer (Sc+D), or C/EBPα-saRNA with oral ezetimibe (R+E). Ezetimibe is a drug that lowers plasma cholesterol levels and is used as a positive control. The body weight and fatty liver status of the mice, including triglyceride level, cholesterol level, and liver size and appearance were recorded and analyzed. The body weight of rats treated with C/EBPα-saRNA formulated in dendrimers and C/EBPα-saRNA with oral ezetimibe was significantly smaller than the other groups. Triglyceride and cholesterol levels in the liver of rats treated with C/EBPα-saRNA formulated in dendrimers reduced respectively. Liver size of the rat treated with C/EBPα-saRNA carried by dendrimers was also reduced to the smallest compared to the control groups. Histopathologic staining of liver tissues was carried out. Liver tissues of mice treated PBS and Sc+D controls were largely red due to fatty liver in obese rats fed high fat diet. On the other hand histopathology of the liver tissues of rats in the experimental group that received saRNA-C/EBPα-dendrimers (R+D) was largely blue due to fat disappearance.

Figure 18A:
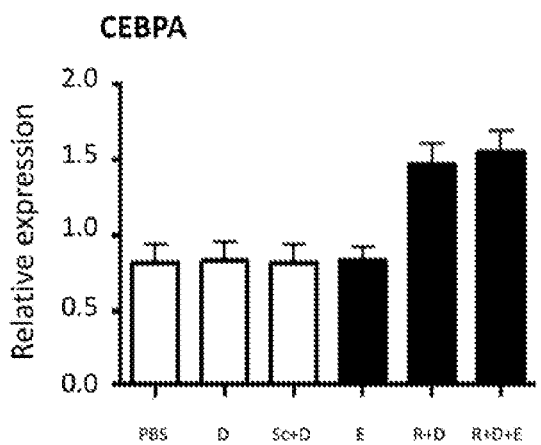
FIG. 18A-18D: Gene expression and serum cholesterol study.
Figure 18B:
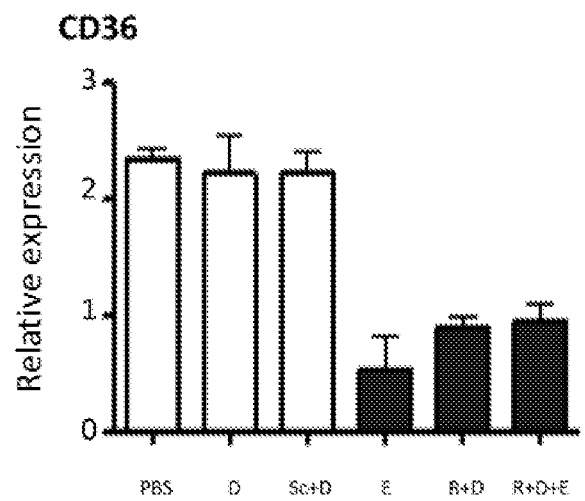
Figure 18C:
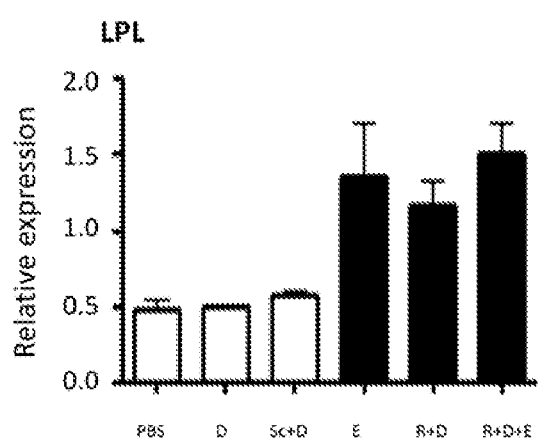
Figure 18D:
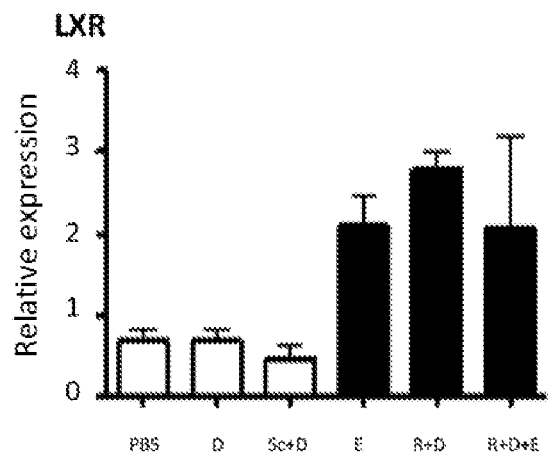
Figure 19:
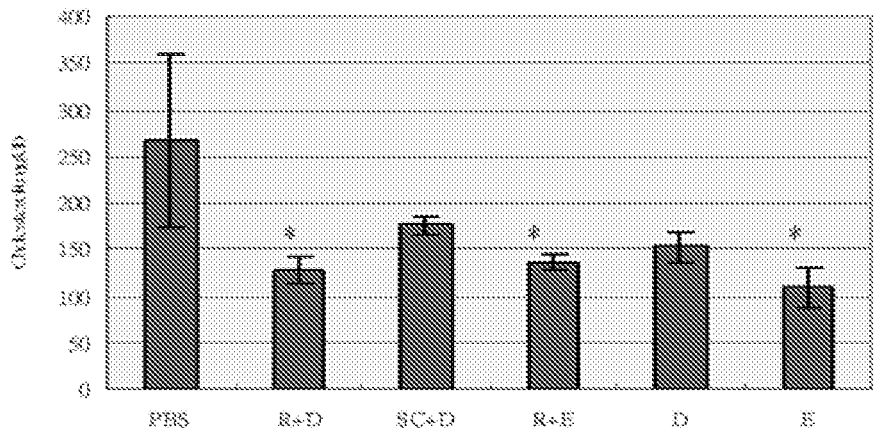
FIG. 19: Serum cholesterol levels of rats treated with C/EBPα-saRNA carried by dendrimers and controls.
Figure 20A:
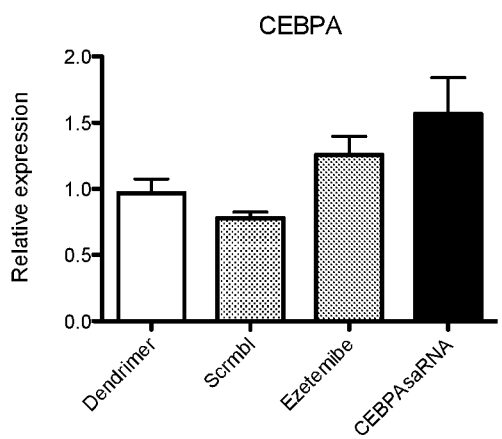
FIG. 20A-20O: Effects on gene expression.
Figure 20B:
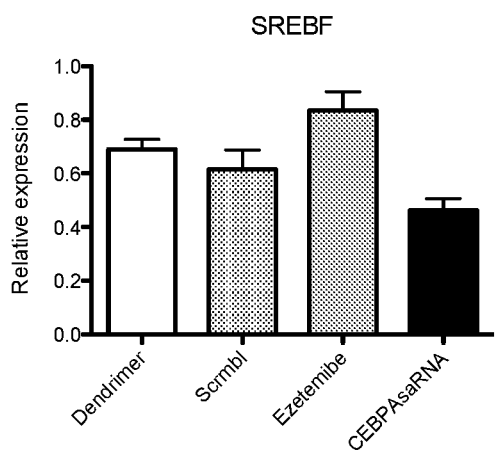
Figure 20C:
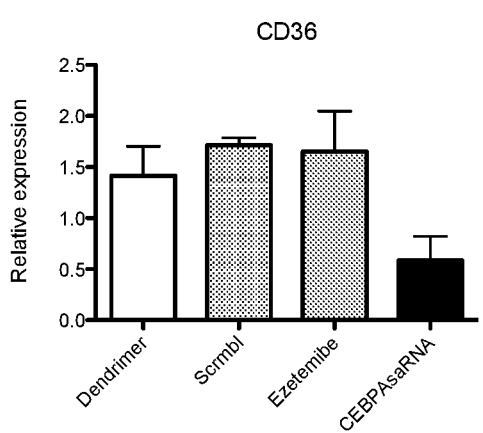
Figure 20D:
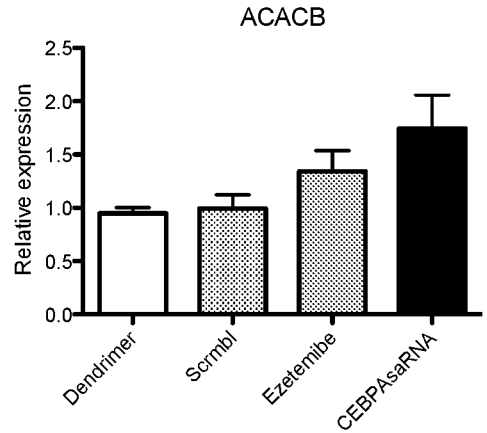
Figure 20E:
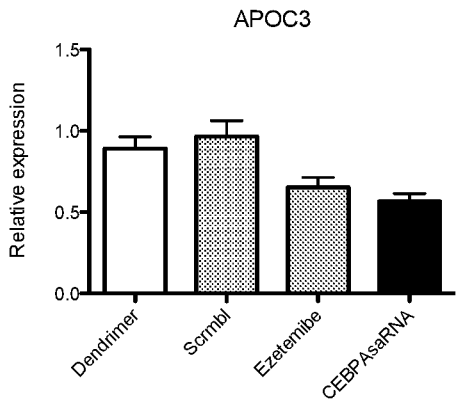
Figure 20F:
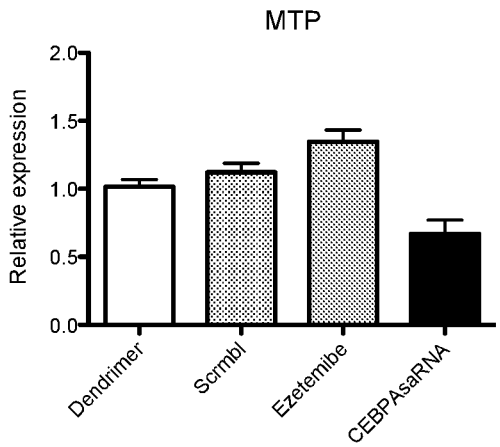
Figure 20G:
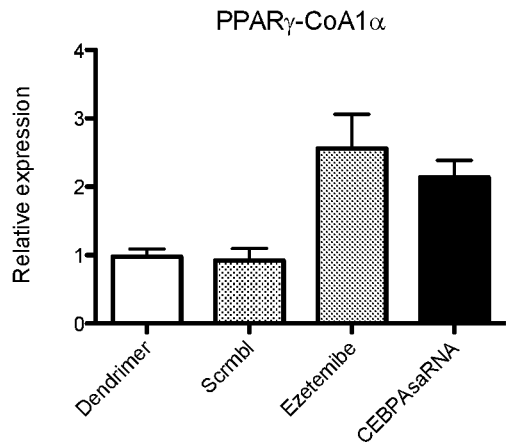
Figure 20H:
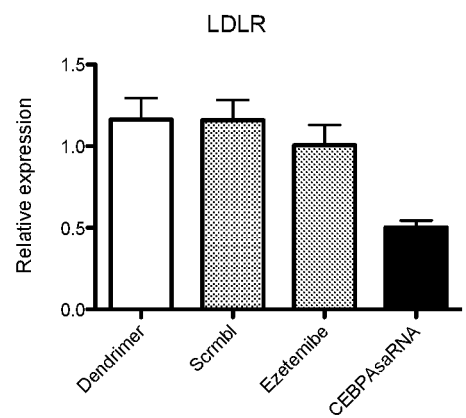
Figure 20I:
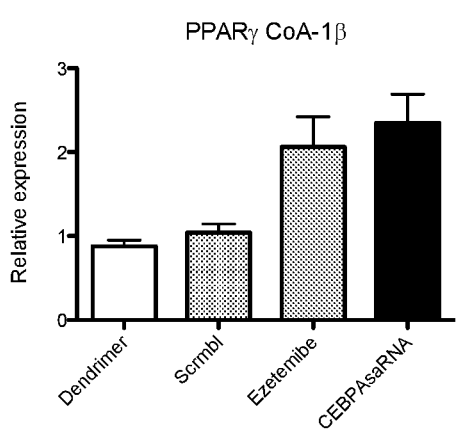
Figure 20J:
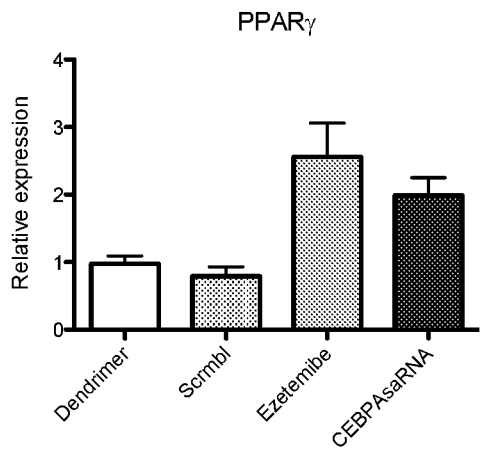
Figure 20K:
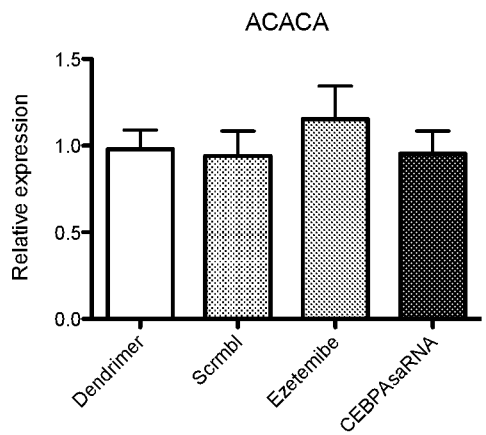
Figure 20L:
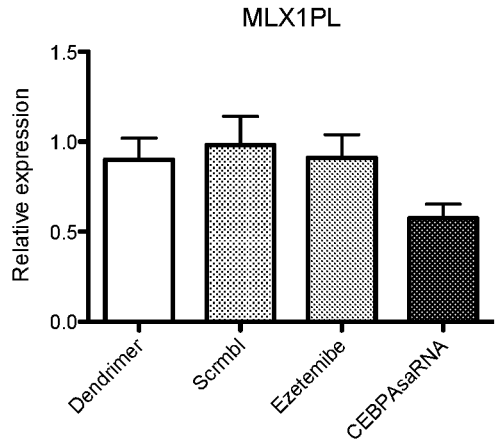
Figure 20M:
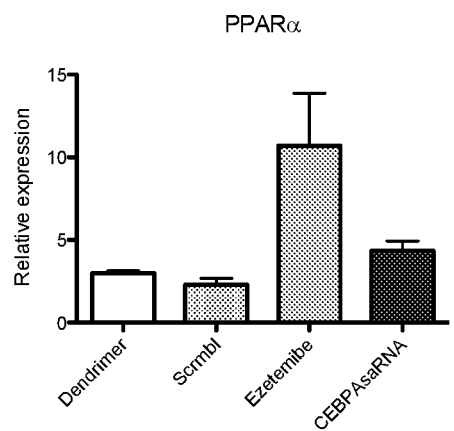
Figure 20N:
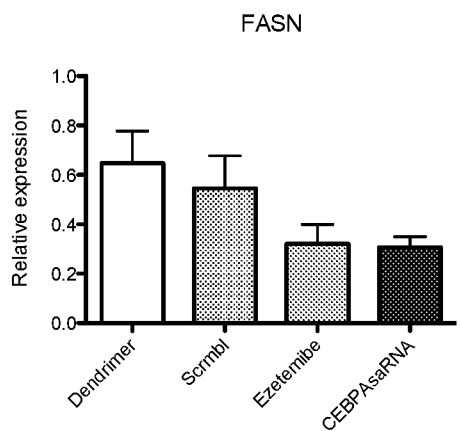
Figure 20O:
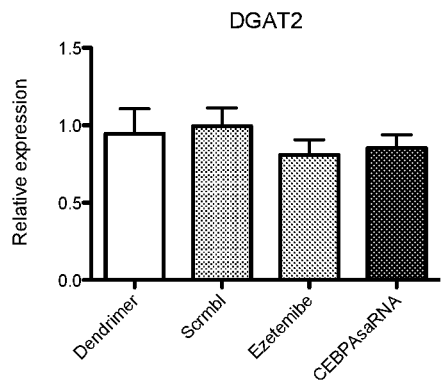
Figure 21A:
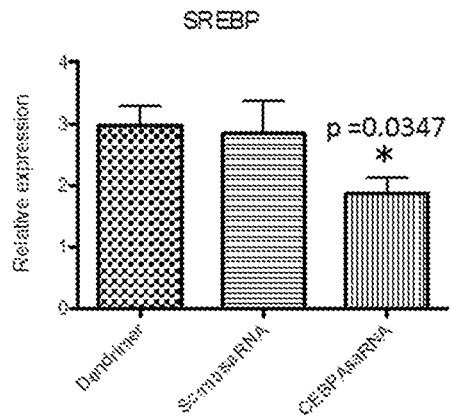
FIG. 21A-21M: Effects on gene expression.
Figure 21B:
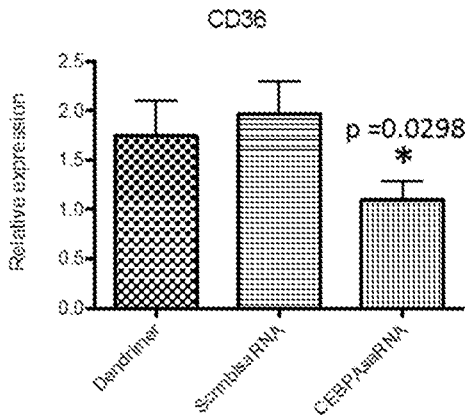
Figure 21C:
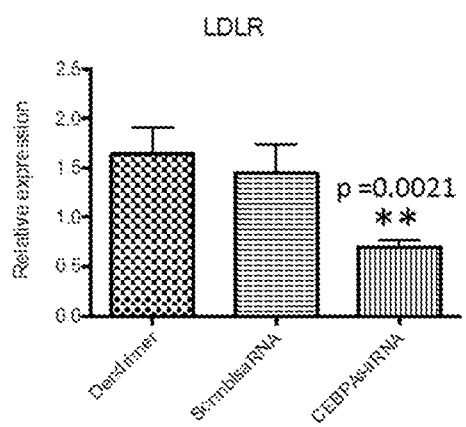
Figure 21D:
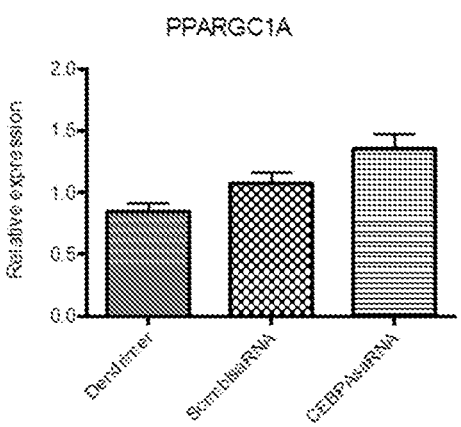
Figure 21E:
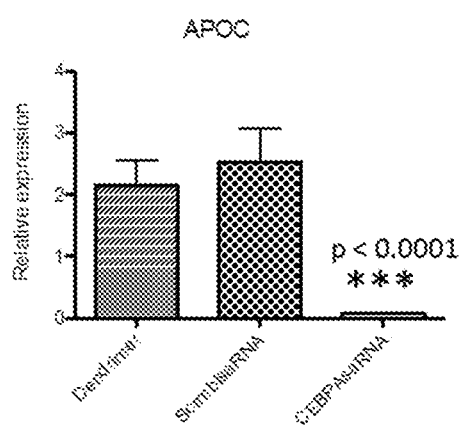
Figure 21F:
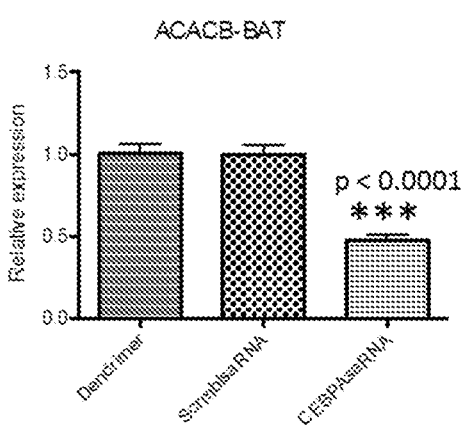
Figure 21G:
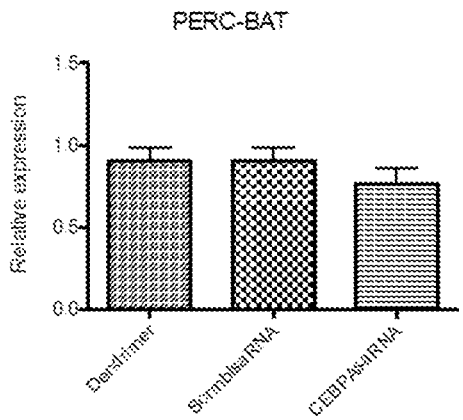
Figure 21H:
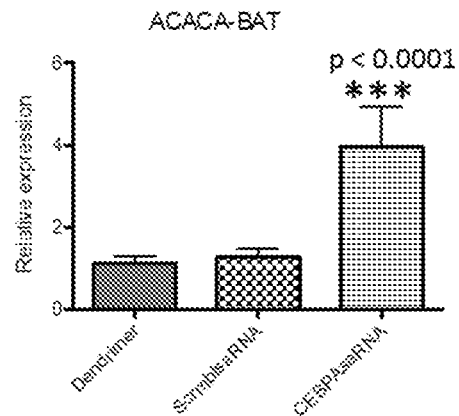
Figure 21I:
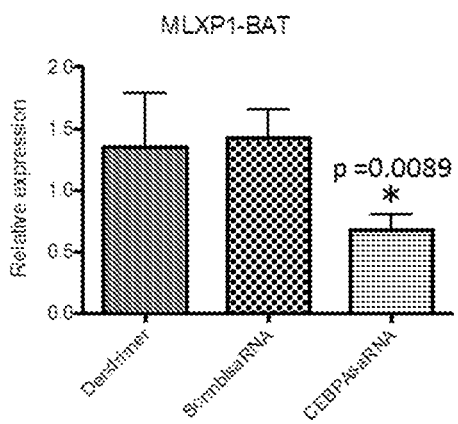
Figure 21J:
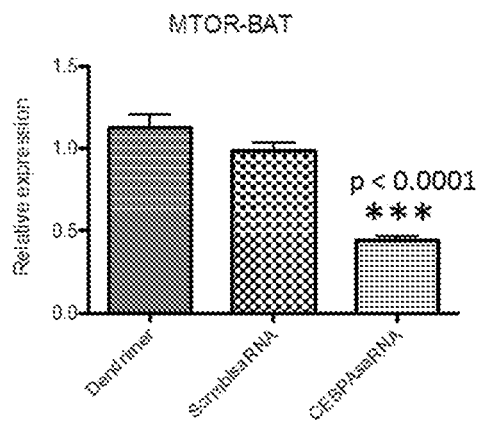
Figure 21K:
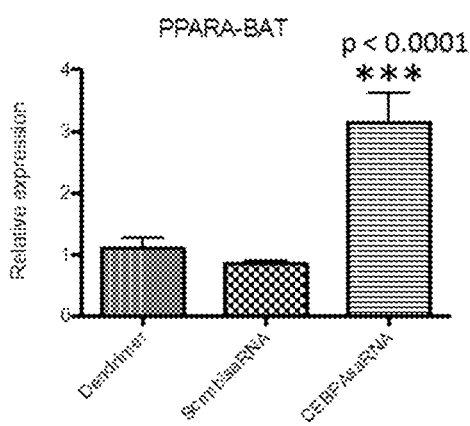
Figure 21L:
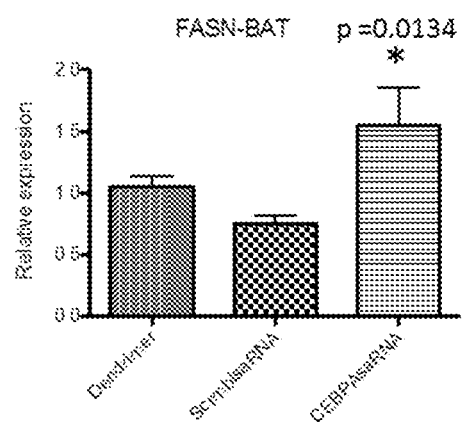
Figure 21M:
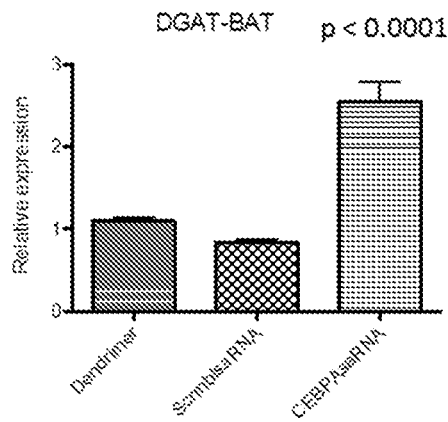
Figure 22A:
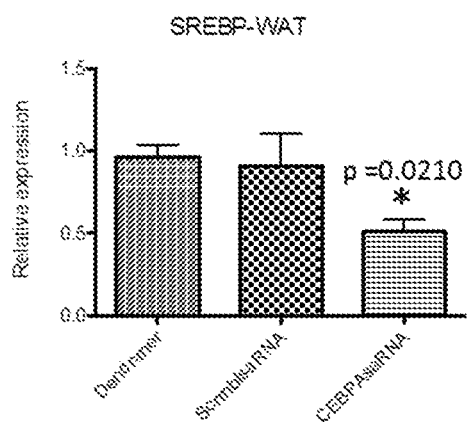
FIG. 22A-22M Effects on gene expression.
Figure 22B:
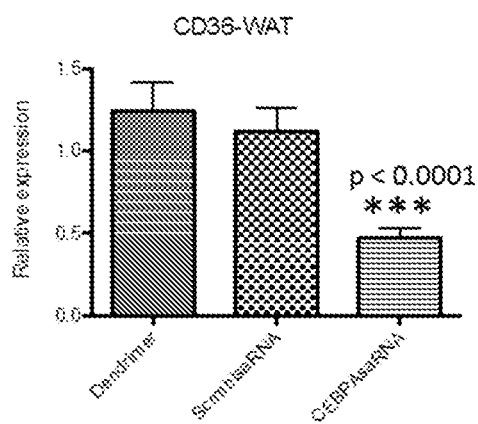
Figure 22C:
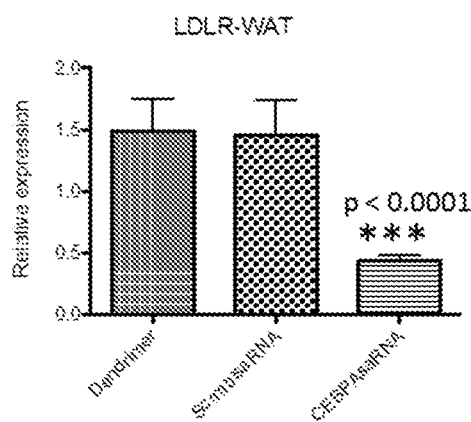
Figure 22D:
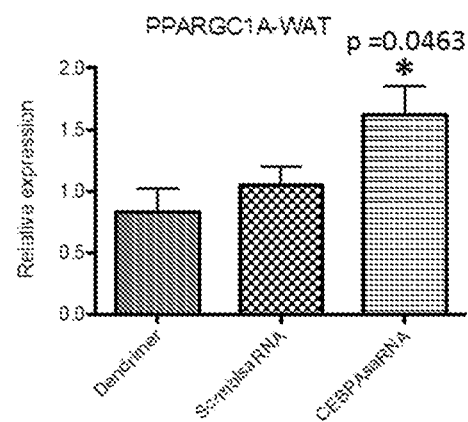
Figure 22E:
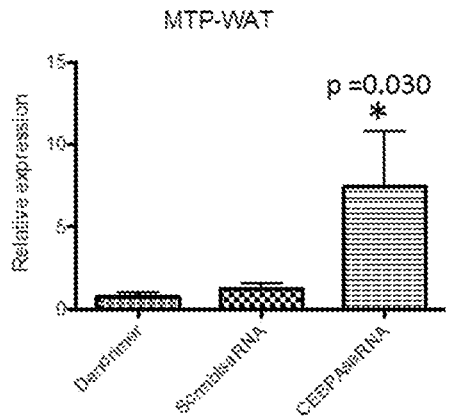
Figure 22F:
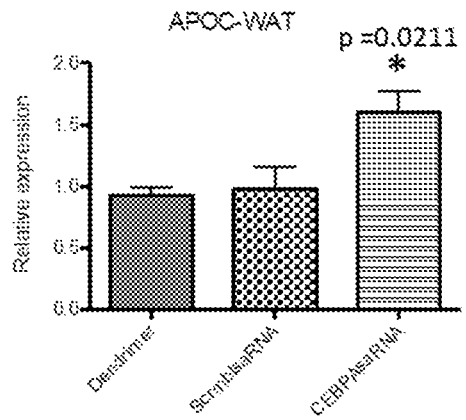
Figure 22G:
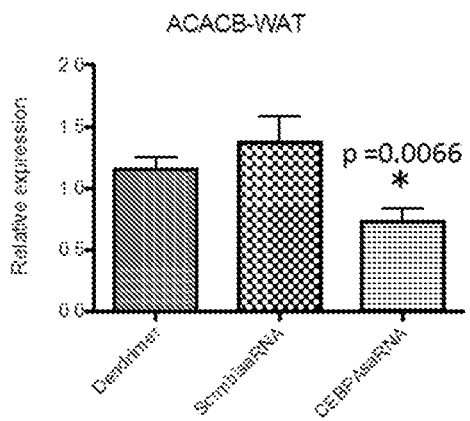
Figure 22H:
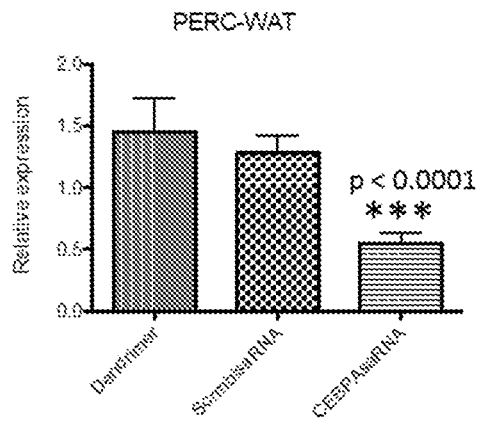
Figure 22I:
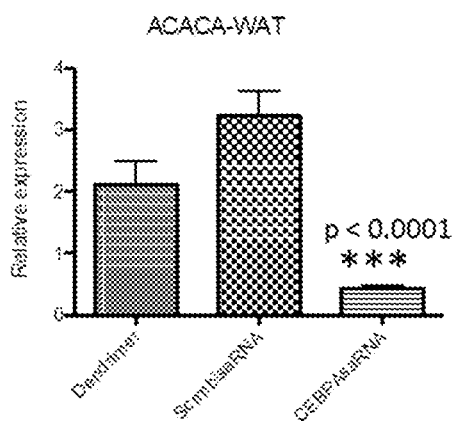
Figure 22J:
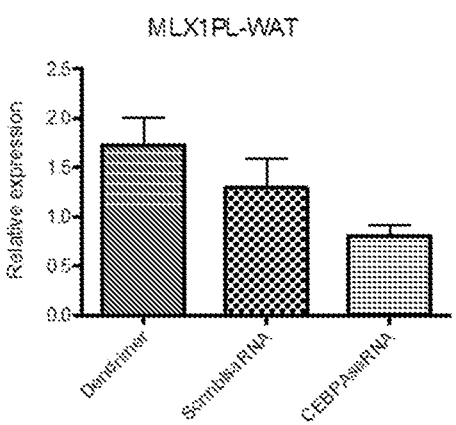
Figure 22K:
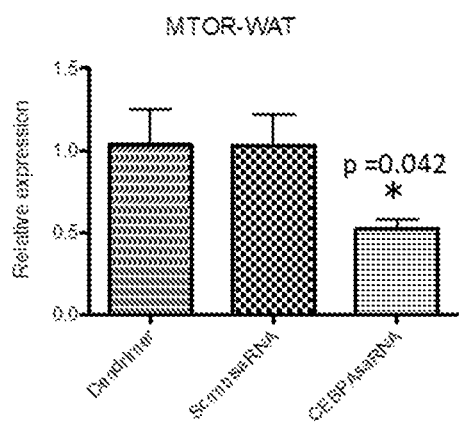
Figure 22L:
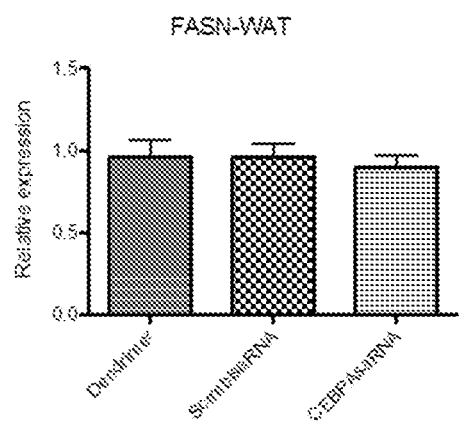
Figure 22M:
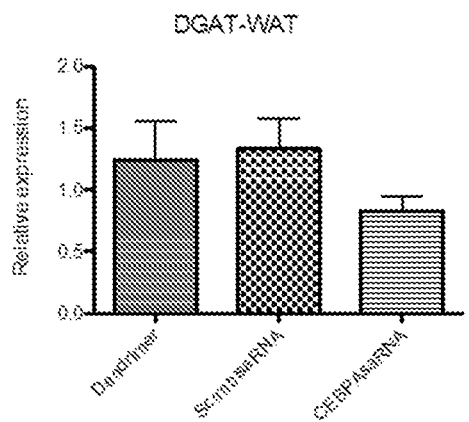

The effect of C/EBPα-saRNA on insulin resistance genes in obese rats was also studied. FAT/CD36, LPL, and LXR were chose for this study. Tissue samples from the treated rats were used to measure the expression level of the various genes. The mRNA transcript levels of FAT/CD36, LPL, and LXR genes were measured (FIG. 18B-D) in vitro by qRT-PCR mRNA expression level. Results show that the expression of FAT/CD36 was reduced, while LPL, and LXR expressions increased after treatment with C/EBPα-saRNA formulated in dendrimers. Serum cholesterol level was reduced (FIG. 19). In another study, the mRNA transcript levels of C/EBPα, SREBF-1, CD36, ACACB, APOC3, MTP, PPARγ-CoA1α, LDLR, PPARγ-CoA1β, PPARγ, ACACA, MLXIPL, PPARα, FASN, DGAT2 from obese rat liver tissues following treatment with dendrimer alone, scramble saRNA, and C/EBPα-saRNA-dendrimers were measured (FIG. 20A-O). Ezetimibe is used as positive control. The expressions of SREBP1 and CETP were reduced by C/EBPα-saRNA (data not shown).

Further, the effect of C/EBPα-saRNA on the metabolic genes in BAT and WAT cells was assessed. BAT and WAT cells were transfected with 20 nM C/EBPα-saRNA, respect-fully, and mRNA levels of metabolic genes were measured as shown in FIG. 21A-21M and FIG. 22A-22M. The expressions of the metabolic genes tested were regulated compared to dendrimer control and scramble RNA control.

A repeat of fatty liver study was also conducted. After a high fat diet, obese rats have been randomly assigned to experimental and control groups. In the experimental group, transcriptional activation of C/EBPα gene was achieved using a 21 bp double-stranded RNA oligonucleotide-dendrimer (saRNA-dendrimer) complex targeted to the liver with a standard low dose and then verify with a bodyweight-adapted drug dose. The systemic and local effect of the saRNA-dendrimer complex on body weight, lipid and energy homeostasis were observed. Results were shown in Tables 11-1 to 11-12.

TABLE 11-1

| | | g/dL Albumin | U/L AST | U/L ALT | mg/dL BUN | mg/dL Creatinine | mg/dL Bilirubin total | HDL/LDL |
|---|---|---|---|---|---|---|---|---|
| PBS | PBS-1 | 4.9 | 86 | 63 | 14.7 | 0.6 | 0.3 | 1.01 |
| | PBS-2 | 4.5 | 120 | 83 | 14 | 0.86 | 0.3 | 0.77 |
| | PBS-3 | 4.3 | 181 | 97 | 14 | 0.67 | 0.3 | 0.54 |
| | PBS-4 | 4.9 | 96 | 79 | 16 | 0.68 | 0.3 | 0.51 |
| | PBS-5 | 4.5 | 121 | 85 | 14 | 0.86 | 0.4 | 0.72 |
| | PBS-6 | 4.6 | 181 | 100 | 15 | 0.65 | 0.3 | 0.54 |
| | PBS-7 | 4.4 | 10 | 79 | 16 | 0.69 | 0.4 | 0.45 |
| | SC + D-1 | 4.6 | 84 | 68 | 12.6 | 0.58 | 0.3 | 0.50 |
| | SC + D-2 | 4.6 | 94 | 51 | 11.8 | 0.71 | 0.5 | 0.47 |
| | SC + D-3 | 4.9 | 109 | 55 | 15.2 | 0.8 | 0.4 | 0.81 |
| | SC + D-4 | 4.6 | 86 | 68 | 12 | 0.59 | 0.3 | 0.55 |
| | SC + D-5 | 4.7 | 94 | 49 | 16 | 0.69 | 0.5 | 0.75 |
| | SC + D-6 | 4.9 | 110 | 53 | 14 | 0.7 | 0.4 | 0.37 |
| | SC + D-7 | 4.6 | 94 | 51 | 13 | 0.71 | 0.5 | 0.77 |
| | SC + D-8 | 4.2 | 105 | 55 | 15 | 0.82 | 0.4 | 0.35 |
| saRNA + dendrimer | R + D-1 | 4.1 | 127 | 70 | 14.1 | 0.67 | 0.3 | 1.04 |
| | R + D-2 | 4.4 | 117 | 80 | 9.8 | 0.62 | 0.4 | 1.09 |
| | R + D-3 | 4.8 | 129 | 105 | 16 | 0.7 | 0.5 | 1.13 |
| | R + D-4 | 4.3 | 96 | 61 | 15.5 | 0.64 | 0.3 | 1.20 |
| | R + D-5 | 4.2 | 77 | 52 | 15.8 | 0.61 | 0.4 | 0.83 |
| | R + D-6 | 4.4 | 115 | 92 | 21.5 | 0.87 | 0.6 | 1.10 |
| | R + D-7 | 4.2 | 118 | 82 | 15.4 | 0.62 | 0.4 | 2.36 |
| dendrimer | D-1 | 4.5 | 84 | 59 | 16 | 0.78 | 0.4 | 0.82 |
| | D-2 | 5 | 89 | 77 | 16.6 | 0.55 | 0.5 | 1.12 |
| | D-3 | 4.3 | 283 | 215 | 16.3 | 0.58 | 0.4 | 0.59 |
| | D-4 | 4.4 | 88 | 82 | 16.2 | 0.8 | 0.4 | 0.82 |
| | D-5 | 4.2 | 89 | 50 | 15 | 0.55 | 0.5 | 1.12 |
| | D-6 | 4.3 | 184 | 142 | 19 | 0.6 | 0.4 | 0.81 |
| | D-7 | 5 | 205 | 100 | 16.3 | 0.58 | 0.3 | 0.55 |

TABLE 11-2

| | | fl M.C.V | K/Cumm Platelet count | cumm WBC | % Neutrophils | % Lymphocytes | % Monocytes |
|---|---|---|---|---|---|---|---|
| PBS | PBS-1 | 51.2 | 1316 | 8200 | 15 | 79.4 | 3.7 |
| | PBS-2 | 51.3 | 1200 | 9300 | 25.6 | 69.5 | 3.5 |
| | PBS-3 | 49.9 | 1261 | 8390 | 24.5 | 71.1 | 4.2 |
| | PBS-4 | 50.8 | 1366 | 6100 | 25.1 | 68.2 | 4.8 |
| | PBS-5 | 51.3 | 1200 | 9300 | 25 | 69 | 3.4 |
| | PBS-6 | 49.9 | 1260 | 8390 | 23.8 | 72 | 4.2 |
| | PBS-7 | 51 | 1300 | 6200 | 24 | 67 | 4.7 |
| | SC + D-1 | 52.8 | 1303 | 9390 | 12.4 | 83.5 | 3.1 |
| | SC + D-2 | 46.3 | 1557 | 10810 | 11.2 | 84.4 | 3.5 |
| | SC + D-3 | 50.3 | 1653 | 11750 | 20.7 | 73 | 4.9 |
| | SC + D-4 | 52.8 | 1303 | 9390 | 12 | 82 | 3.3 |
| | SC + D-5 | 46 | 1550 | 11000 | 11 | 84.5 | 3.5 |
| | SC + D-6 | 52 | 1640 | 12000 | 20.7 | 73 | 5 |
| | SC + D-7 | 46 | 1400 | 9370 | 11.3 | 81 | 3.3 |
| | SC + D-8 | 51 | 1653 | 11750 | 23 | 74 | 4.9 |
| saRNA + dendrimer | R + D-1 | 45.8 | 1683 | 11250 | 30.4 | 66.4 | 1.6 |
| | R + D-2 | 48.2 | 1554 | 14190 | 24.2 | 71.5 | 3.9 |
| | R + D-3 | 45.8 | 1819 | 12150 | 17.1 | 79.8 | 2.6 |
| | R + D-4 | 50.1 | 1415 | 11850 | 19.3 | 77.5 | 2.2 |
| | R + D-5 | 47.6 | 1672 | 14630 | 13.5 | 80.4 | 5.2 |
| | R + D-6 | 50.1 | 1746 | 7470 | 26.3 | 69.7 | 2.9 |
| | R + D-7 | 46.9 | 1553 | 10390 | 28.1 | 68.7 | 1.5 |
| dendrimer | D-1 | 48.1 | 1648 | 12310 | 15.7 | 77.7 | 4.5 |
| | D-2 | 57.5 | 1542 | 8300 | 21 | 75.1 | 3.1 |
| | D-3 | 46.3 | 1193 | 14380 | 17.5 | 74.4 | 7.9 |

TABLE 11-2-continued

|   | fl M.C.V | K/Cumm Platelet count | cumm WBC | % Neutrophils | % Lymphocytes | % Monocytes |
|---|---|---|---|---|---|---|
| D-4 | 48 | 1650 | 12000 | 15.4 | 77 | 4.4 |
| D-5 | 57.3 | 1450 | 8100 | 20.5 | 75.1 | 3 |
| D-6 | 46 | 1180 | 12400 | 17 | 74.8 | 7.9 |
| D-7 | 46.3 | 1093 | 14200 | 17.5 | 72 | 6 |

TABLE 11-3

|   |   | Eosinophils | Basophils | RBC | Hematocrit | M.C.H | M.C.H.C | Hemoglobin |
|---|---|---|---|---|---|---|---|---|
| PBS | PBS-1 | 1.7 | 0.2 | 9.51 | 48.7 | 17.2 | 33.7 | 16.4 |
|  | PBS-2 | 1.3 | 0.1 | 8.69 | 44.6 | 17.1 | 33.4 | 14.9 |
|  | PBS-3 | 0.2 | 0.5 | 8.52 | 42.5 | 17 | 34.1 | 14.5 |
|  | PBS-4 | 1.6 | 0.3 | 8.15 | 41.4 | 17.2 | 33.8 | 14 |
|  | PBS-5 | 1.5 | 0.2 | 8.65 | 44.2 | 17.1 | 34 | 14 |
|  | PBS-6 | 0.2 | 0.5 | 8.4 | 41.4 | 17.3 | 34.1 | 15 |
|  | PBS-7 | 1.6 | 0.3 | 8.15 | 39 | 17.2 | 33.5 | 14 |
|  | SC + D-1 | 0.9 | 0.1 | 9.52 | 50.3 | 17.8 | 33.6 | 16.9 |
|  | SC + D-2 | 0.7 | 0.2 | 10.04 | 46.5 | 16.4 | 35.5 | 16.5 |
|  | SC + D-3 | 1.2 | 0.2 | 9.01 | 45.3 | 16.8 | 33.3 | 15.1 |
|  | SC + D-4 | 0.9 | 0.1 | 9.5 | 50 | 17.8 | 33.8 | 16.9 |
|  | SC + D-5 | 0.7 | 0.2 | 10 | 46.5 | 16 | 34 | 16 |
|  | SC + D-6 | 1.1 | 0.2 | 9.01 | 44 | 15.8 | 32 | 15.1 |
|  | SC + D-7 | 0.8 | 0.2 | 9.8 | 46 | 16.9 | 33 | 15.8 |
|  | SC + D-8 | 1.2 | 0.2 | 9 | 41 | 16.8 | 37 | 15.7 |
| saRNA + dendrimer | R + D-1 | 1.5 | 0.1 | 8.5 | 38.9 | 16.1 | 35.2 | 13.7 |
|  | R + D-2 | 0.4 | 0.1 | 10.02 | 48.3 | 16.8 | 34.8 | 16.8 |
|  | R + D-3 | 0.3 | 0.2 | 10.22 | 46.8 | 16.1 | 35.3 | 16.5 |
|  | R + D-4 | 0.8 | 0.2 | 8.52 | 42.7 | 17 | 34 | 14.5 |
|  | R + D-5 | 0.8 | 0.1 | 8.89 | 42.3 | 16.3 | 34.3 | 14.5 |
|  | R + D-6 | 0.8 | 0.3 | 9.02 | 45.2 | 17.5 | 35 | 15.8 |
|  | R + D-7 | 1.6 | 0.1 | 8.62 | 40.4 | 16.1 | 34.4 | 13.9 |
| dendrimer | D-1 | 1.5 | 0.6 | 9.14 | 44 | 16.5 | 34.3 | 15.1 |
|  | D-2 | 0.4 | 0.4 | 7.25 | 41.7 | 18.1 | 31.4 | 13.1 |
|  | D-3 | 0.2 | 0.8 | 8.83 | 40.9 | 16 | 34.5 | 14.1 |
|  | D-4 | 1.3 | 0.6 | 9 | 42 | 15 | 34 | 14.7 |
|  | D-5 | 0.8 | 0.4 | 7.25 | 40 | 13 | 33 | 13.6 |
|  | D-6 | 0.2 | 0.2 | 8.5 | 44 | 19 | 37.5 | 16 |
|  | D-7 | 0.2 | 0.8 | 8.7 | 41 | 16 | 34.5 | 14.1 |

TABLE 11-4

| body weight | 7th week | 8th week | 9th week | 10th week | body weight gain (7th~10th week) |
|---|---|---|---|---|---|
| PBS-1 | 440 | 455 | 465 | 465 | 25 |
| PBS-2 | 505 | 515 | 525 | 530 | 25 |
| PBS-3 | 505 | 525 | 540 | 535 | 30 |
| PBS-4 | 495 | 510 | 520 | 520 | 25 |
| PBS-5 | 440 | 455 | 465 | 465 | 25 |
| PBS-6 | 504 | 516 | 527 | 542 | 38 |
| PBS-7 | 505 | 525 | 532 | 536 | 31 |
| SC + D-1 | 475 | 485 | 500 | 490 | 15 |
| SC + D-2 | 420 | 435 | 450 | 450 | 30 |
| SC + D-3 | 475 | 485 | 500 | 490 | 15 |
| SC + D-4 | 420 | 435 | 450 | 450 | 30 |
| SC + D-5 | 473 | 485 | 500 | 510 | 37 |
| SC + D-6 | 420 | 435 | 460 | 455 | 35 |
| SC + D-7 | 475 | 480 | 480 | 490 | 15 |
| SC + D-8 | 423 | 435 | 450 | 470 | 47 |
| R + D-1 | 480 | 485 | 485 | 480 | 0 |
| R + D-2 | 515 | 535 | 535 | 525 | 10 |
| R + D-3 | 435 | 440 | 445 | 435 | 0 |
| R + D-4 | 515 | 520 | 530 | 515 | 0 |
| R + D-5 | 535 | 555 | 560 | 540 | 5 |
| R + D-6 | 460 | 485 | 490 | 490 | 30 |
| R + D-7 | 465 | 470 | 480 | 475 | 10 |
| D-1 | 465 | 465 | 475 | 475 | 10 |
| D-2 | 410 | 415 | 420 | 420 | 10 |
| D-3 | 585 | 600 | 610 | 610 | 25 |
| D-4 | 462 | 465 | 475 | 480 | 18 |
| D-5 | 415 | 420 | 420 | 440 | 25 |
| D-6 | 565 | 600 | 610 | 605 | 35 |
| D-7 | 460 | 465 | 475 | 482 | 22 |

TABLE 11-5

|   | liver weight | liver/body | white fat | white fat /body |
|---|---|---|---|---|
| PBS-1 | 19 | 0.041 | 19 | 0.041 |
| PBS-2 | 23 | 0.043 | 18.4 | 0.035 |
| PBS-3 | 25 | 0.047 | 22.5 | 0.042 |
| PBS-4 | 26.2 | 0.050 | 26 | 0.050 |
| PBS-5 | 19 | 0.041 | 20 | 0.043 |
| PBS-6 | 24 | 0.044 | 18.9 | 0.035 |
| PBS-7 | 25 | 0.047 | 24 | 0.045 |

TABLE 11-5-continued

|  | liver weight | liver/body | white fat | white fat /body |
|---|---|---|---|---|
| SC + D-1 | 18.6 | 0.038 | 18 | 0.037 |
| SC + D-2 | 20.6 | 0.046 | 14 | 0.031 |
| SC + D-3 | 18.6 | 0.038 | 18 | 0.037 |
| SC + D-4 | 20.6 | 0.046 | 14 | 0.031 |
| SC + D-5 | 18.5 | 0.036 | 21 | 0.041 |
| SC + D-6 | 21 | 0.046 | 19 | 0.042 |
| SC + D-7 | 18.4 | 0.038 | 21 | 0.043 |
| SC + D-8 | 20.6 | 0.044 | 18 | 0.038 |
| R + D-1 | 18.2 | 0.038 | 16 | 0.033 |
| R + D-2 | 23.4 | 0.045 | 18.2 | 0.035 |
| R + D-3 | 18 | 0.041 | 16.8 | 0.039 |
| R + D-4 | 21.4 | 0.042 | 16.5 | 0.032 |
| R + D-5 | 24.8 | 0.046 | 21 | 0.039 |
| R + D-6 | 23 | 0.047 | 17 | 0.035 |
| R + D-7 | 19.6 | 0.041 | 15 | 0.032 |
| D-1 | 23.6 | 0.050 | 16.3 | 0.034 |
| D-2 | 21.8 | 0.052 | 14 | 0.033 |
| D-3 | 33 | 0.054 | 22.3 | 0.037 |
| D-4 | 24 | 0.050 | 18 | 0.038 |
| D-5 | 20 | 0.045 | 17 | 0.039 |
| D-6 | 34 | 0.056 | 23.5 | 0.039 |
| D-7 | 25 | 0.052 | 19 | 0.039 |

TABLE 11-6

|  | brown fat | brown fat/body | muscle/body | muscle from leg |
|---|---|---|---|---|
| PBS-1 | 0.36 | 0.000774 | 0.0026 | 1.2 |
| PBS-2 | 0.4 | 0.000755 | 0.0024 | 1.29 |
| PBS-3 | 0.4 | 0.000748 | 0.0026 | 1.37 |
| PBS-4 | 0.38 | 0.000731 | 0.0023 | 1.2 |
| PBS-5 | 0.35 | 0.000753 | 0.0026 | 1.2 |
| PBS-6 | 0.42 | 0.000775 | 0.0022 | 1.2 |
| PBS-7 | 0.4 | 0.000746 | 0.0026 | 1.4 |
| SC + D-1 | 0.43 | 0.000878 | 0.0024 | 1.2 |
| SC + D-2 | 0.31 | 0.000689 | 0.0022 | 1 |
| SC + D-3 | 0.42 | 0.000857 | 0.0029 | 1.4 |
| SC + D-4 | 0.33 | 0.000733 | 0.0024 | 1.1 |
| SC + D-5 | 0.31 | 0.000608 | 0.0022 | 1.1 |
| SC + D-6 | 0.43 | 0.000945 | 0.0020 | 0.9 |
| SC + D-7 | 0.5 | 0.001020 | 0.0022 | 1.1 |
| SC + D-8 | 0.2 | 0.000426 | 0.0021 | 1 |
| R + D-1 | 0.3 | 0.000625 | 0.0023 | 1.1 |
| R + D-2 | 0.48 | 0.000914 | 0.0024 | 1.26 |
| R + D-3 | 0.33 | 0.000759 | 0.0024 | 1.03 |
| R + D-4 | 0.4 | 0.000777 | 0.0026 | 1.34 |
| R + D-5 | 0.43 | 0.000796 | 0.0022 | 1.2 |
| R + D-6 | 0.4 | 0.000816 | 0.0025 | 1.23 |
| R + D-7 | 0.36 | 0.000758 | 0.0024 | 1.12 |
| D-1 | 0.25 | 0.000526 | 0.0025 | 1.2 |
| D-2 | 0.35 | 0.000833 | 0.0028 | 1.16 |
| D-3 | 0.36 | 0.000590 | 0.0023 | 1.4 |
| D-4 | 0.3 | 0.000625 | 0.0027 | 1.3 |
| D-5 | 0.32 | 0.000727 | 0.0025 | 1.1 |
| D-6 | 0.35 | 0.000579 | 0.0023 | 1.38 |
| D-7 | 0.24 | 0.000498 | 0.0024 | 1.18 |

TABLE 11-7

| Before injection | mg/dL Cholesterol total | mg/dL HDL | mg/dL LDL | HDL/LDL | mg/dL Triglyceride |
|---|---|---|---|---|---|
| PBS-1 | 91 | 12.7 | 10.2 | 1.25 | 76 |
| PBS-2 | 88 | 13 | 14.3 | 0.91 | 62 |
| PBS-3 | 75 | 8 | 12 | 0.67 | 55 |
| PBS-4 | 120 | 10.1 | 17.8 | 0.57 | 62 |
| PBS-5 | 92 | 12.5 | 10.2 | 1.23 | 72 |
| PBS-6 | 87 | 13.2 | 14 | 0.94 | 63 |
| PBS-7 | 76 | 7 | 13 | 0.54 | 55 |
| SC + D-1 | 97 | 10.5 | 14.5 | 0.72 | 48 |
| SC + D-2 | 66 | 10.9 | 11.5 | 0.95 | 42 |

TABLE 11-7-continued

| Before injection | mg/dL Cholesterol total | mg/dL HDL | mg/dL LDL | HDL/LDL | mg/dL Triglyceride |
|---|---|---|---|---|---|
| SC + D-3 | 75 | 14.8 | 9.1 | 1.63 | 72 |
| SC + D-4 | 70 | 9.3 | 12 | 0.78 | 53 |
| SC + D-5 | 78 | 11.8 | 10.5 | 1.12 | 46 |
| SC + D-6 | 68 | 7.3 | 11.7 | 0.62 | 50 |
| SC + D-7 | 78 | 11.8 | 11 | 1.07 | 46 |
| SC + D-8 | 68 | 7 | 11.2 | 0.63 | 50 |
| R + D-1 | 129 | 7.9 | 15.9 | 0.50 | 70 |
| R + D-2 | 78 | 7.4 | 13.4 | 0.55 | 77 |
| R + D-3 | 129 | 7.9 | 15.9 | 0.50 | 70 |
| R + D-4 | 78 | 7.4 | 13.4 | 0.55 | 77 |
| R + D-5 | 122 | 8.2 | 17.4 | 0.47 | 93 |
| R + D-6 | 142 | 14.9 | 19.3 | 0.77 | 95 |
| R + D-7 | 125 | 6.1 | 15 | 0.41 | 47 |
| D-1 | 93 | 10.7 | 13.5 | 0.79 | 47 |
| D-2 | 68 | 12.2 | 8.7 | 1.40 | 56 |
| D-3 | 95 | 10.3 | 12.6 | 0.82 | 58 |
| D-4 | 93 | 10.8 | 13.5 | 0.80 | 47 |
| D-5 | 68 | 12 | 8.7 | 1.38 | 55 |
| D-6 | 96 | 11 | 12 | 0.92 | 58 |
| D-7 | 93 | 10.7 | 14 | 0.76 | 50 |

TABLE 11-8

| After-before | mg/dL Cholesterol total | mg/dL HDL | mg/dL LDL | HDL/LDL | mg/dL. Triglyceride |
|---|---|---|---|---|---|
| PBS-1 | 14 | 0.9 | 3.3 | −0.24 | −10 |
| PBS-2 | 28 | −0.8 | 1.6 | −0.14 | 12 |
| PBS-3 | 31 | 0.1 | 3.1 | −0.13 | −7 |
| PBS-4 | −1 | −2.2 | −2.3 | −0.06 | −4 |
| PBS-5 | 14 | 0.9 | 3.3 | −0.51 | 2 |
| PBS-6 | 29 | −0.7 | 1.5 | −0.41 | −9 |
| PBS-7 | 27 | 0.2 | 3.1 | −0.08 | 13 |
| SC + D-1 | 31 | −1.1 | 4.4 | −0.23 | 33 |
| SC + D-2 | 61 | −4.3 | 2.6 | −0.48 | 14 |
| SC + D-3 | 10 | −5.9 | 1.9 | −0.82 | −16 |
| SC + D-4 | 51 | −1.3 | 2.6 | −0.23 | 10 |
| SC + D-5 | 4 | −3.3 | 0.8 | −0.37 | 30 |
| SC + D-6 | 43 | −0.2 | 7.6 | −0.26 | 12 |
| SC + D-7 | 4 | −2 | 0.8 | −0.30 | 30 |
| SC + D-8 | 43 | −0.2 | 7.6 | −0.28 | 12 |
| R + D-1 | −33 | 3.9 | −5 | 0.54 | 27 |
| R + D-2 | 2 | 5.7 | −3 | 0.54 | −32 |
| R + D-3 | −33 | 4.4 | −5 | 0.63 | 27 |
| R + D-4 | 2 | 5.1 | −3 | 0.65 | −32 |
| R + D-5 | 3 | 6.7 | 0.5 | 0.36 | 32 |
| R + D-6 | −13 | 4.3 | −1.8 | 0.33 | −48 |
| R + D-7 | −35 | 13.7 | −6.6 | 1.95 | −3 |
| D-1 | 45 | 4 | 4.5 | 0.02 | 21 |
| D-2 | 21 | 1 | 3.1 | −0.28 | 9 |
| D-3 | 41 | 3.2 | 10.4 | −0.23 | 21 |
| D-4 | 43 | 2 | 4.5 | 0.02 | 21 |
| D-5 | 25 | 1 | 3.1 | −0.26 | 9 |
| D-6 | 41 | 1.8 | 10 | −0.11 | 11 |
| D-7 | 45 | 4 | 5 | −0.22 | 12 |

TABLE 11-9

| After injection | | pg/mL IL-6 | U/L IL-1b | U/L TNF-a |
|---|---|---|---|---|
| PBS | PBS-1 | 142 | 280 | 63 |
|  | PBS-2 | 133 | 250 | 83 |
|  | PBS-3 | 124 | 320 | 97 |
|  | PBS-4 | 133 | 185 | 79 |
|  | PBS-5 | 176 | 180 | 85 |
|  | PBS-6 | 104 | 201 | 100 |
|  | PBS-7 | 99 | 270 | 79 |

TABLE 11-9-continued

| After injection | | pg/mL IL-6 | U/L IL-1b | U/L TNF-a |
|---|---|---|---|---|
| scramble saRNA + dendrimer | SC + D-1 | 112 | 270 | 68 |
| | SC + D-2 | 132 | 380 | 51 |
| | SC + D-3 | 95 | 360 | 55 |
| | SC + D-4 | 110 | 349 | 68 |
| | SC + D-5 | 142 | 210 | 49 |
| | SC + D-6 | 106 | 108 | 53 |
| | SC + D-7 | 132 | 200 | 51 |
| | SC + D-8 | 122 | 185 | 55 |
| saRNA + dendrimer | R + D-1 | 62 | 56 | 70 |
| | R + D-2 | 73 | 72 | 80 |
| | R + D-3 | 64 | 80 | 105 |
| | R + D-4 | 83 | 62 | 61 |
| | R + D-5 | 42 | 60 | 52 |
| | R + D-6 | 85 | 88 | 92 |
| | R + D-7 | 75 | 84 | 82 |
| dendrimer | D-1 | 105 | 223 | 59 |
| | D-2 | 119 | 220 | 77 |
| | D-3 | 162 | 180 | 215 |
| | D-4 | 99 | 208 | 82 |
| | D-5 | 123 | 195 | 50 |
| | D-6 | 113 | 300 | 142 |
| | D-7 | 129 | 195 | 100 |

TABLE 11-10

| IL6 (pg/mL) | PBS | SC + D | R + D | D |
|---|---|---|---|---|
| 1 | 142 | 112 | 62 | 105 |
| 2 | 133 | 132 | 73 | 119 |
| 3 | 124 | 95 | 64 | 162 |
| 4 | 133 | 110 | 83 | 99 |
| 5 | 176 | 142 | 42 | 123 |
| 6 | 104 | 106 | 85 | 113 |
| 7 | 99 | 132 | 75 | 129 |
| 8 | | 122 | | |
| AVERAGE | 130.14 | 118.88 | 69.14 | 121.43 |
| sd | 23.76 | 14.79 | 13.66 | 19.11 |
| T TEST | | 0.32 | 0.00 | 0.50 |

TABLE 11-11

| IL-1b (pg/mL) | PBS | SC + D | R + D | D |
|---|---|---|---|---|
| 1 | 280 | 270 | 56 | 223 |
| 2 | 250 | 380 | 72 | 220 |
| 3 | 320 | 360 | 80 | 180 |
| 4 | 185 | 349 | 62 | 208 |
| 5 | 180 | 210 | 60 | 195 |
| 6 | 201 | 108 | 88 | 300 |
| 7 | 270 | 200 | 84 | 195 |
| 8 | | 185 | | |
| AVERAGE | 240.86 | 257.75 | 71.71 | 217.29 |
| sd | 49.48 | 91.66 | 11.73 | 36.55 |
| T TEST | | 0.69 | 0.00 | 0.37 |

TABLE 11-12

| TNF-α (pg/mL) | PBS | SC + D | R + D | D |
|---|---|---|---|---|
| 1 | 1200 | 1210 | 320 | 1050 |
| 2 | 1107 | 990 | 600 | 970 |
| 3 | 980 | 870 | 640 | 1300 |
| 4 | 1204 | 1005 | 580 | 1005 |
| 5 | 1008 | 890 | 640 | 890 |
| 6 | 990 | 889 | 700 | 1020 |
| 7 | 840 | 780 | 820 | 1140 |
| 8 | | 105 | | |
| AVERAGE | 1047.00 | 842.38 | 614.29 | 1053.57 |
| sd | 121.75 | 303.36 | 140.90 | 122.73 |
| T TEST | | 0.14 | 0.00 | 0.93 |

In the experimental group, serum cholesterol and body weight were significantly reduced. High-dose of C/EBPα saRNA notably lowered serum triglyceride, improved serum lipoprotein profile and decreased white adipose tissue content. Gene expression analysis showed a significant change in gene transcription activation in the experimental group in comparison with control groups. In the liver, C/EBPα significantly decreased the expression of genes involved in fatty acid uptake (CD36) and hepatic de novo lipogenesis (SREBP-1, ChREBP), whilst beta-oxidation (PPARα, PPARγ-CoA1α, PPARγ-CoA1β) and insulin sensitivity genes (PPARγ) were upregulated. In white adipose tissue, decreased expression of CD36 and ACACB genes was found, suggesting a reduction in inflammation and an increase in beta-oxidation, respectively. Downregulation of genes involved in white adipose tissue lipogenesis was noted (SREBP-1, ACACA, mTOR). Finally, enhanced expression of PPARγ-CoA1α in white adipose tissue was also observed. C/EBPα improved liver steatosis and hepatic energy metabolism with positive systemic effects on insulin resistance, metabolic abnormality and body fat in a NAFLD model. Low-dose of C/EBPα saRNA had a positive effect on body weight that could be mediated by improvement in hepatic lipid and glucose metabolism and by secondary positive effect on white adipose tissue. High-dose of C/EBPα saRNA had a stronger antidyslipidemic action probably due to a broader systemic effect.

Therefore, C/EBPα-saRNA may be used as a therapeutic agent to treat NAFLD and to reduce triglyceride and LDL cholesterol levels in liver cells. It may also be used to reduce insulin resistance, systemic lipidaemia, hyperinsulinaemia and steatosis in patients in need thereof.

| Gene | SEQ ID | Ref SEQ ID |
|---|---|---|
| FAT/CD36 | 207 | NM_000072.3 |
| FAT/CD36 (mouse) | 221 | NM_001159555 |
| LPL | 208 | NM_000237.2 |
| LPL (mouse) | 222 | NM_008509.2 |
| LXR | 209 | NM_005693.3 |
| LXR (mouse) | 223 | NM_013839.4 |
| SREBP1 | 210 | NM_004176 |
| SREBP1 (mouse) | 224 | NM_011480 |
| DGAT2 | 211 | NM_032564 |
| DGAT2 (mouse) | 225 | NM_026384.3 |
| CETP | 212 | NM_000078 |
| FASN | 213 | NM_004104.4 |
| FASN (mouse) | 226 | NM_007988.3 |
| Albumin | 219 | NM_000477.5 |
| Albumin (mouse) | 227 | NM_009654.3 |
| ACACA | 228 | NM_198834.1 |
| ACACA (mouse) | 229 | NM_133360 |
| ACACB | 230 | NM_001093.3 |
| ACACB (mouse) | 231 | NM_133904 |
| APOC3 | 232 | NM_000040.1 |
| APOC3 (mouse) | 233 | NM_023114 |
| MTP | 234 | NM_000253.2 |
| MTP (mouse) | 235 | NM_001163457 |
| PPARγ-CoA1α | 236 | NM_013261.3 |

| Gene | SEQ ID | Ref SEQ ID |
|---|---|---|
| PPARγ-CoA1α (mouse) | 237 | NM_008904.2 |
| PPARγ-CoA1β | 238 | NM_133263.3 |
| PPARγ-CoA1β (mouse) | 239 | NM_133249.2 |
| PPARγ | 240 | NM_138712.3 |
| PPARγ (mouse) | 241 | NM_001127330 |
| PPARα | 242 | M_001001928.2 |
| PPARα (mouse) | 243 | NM_011144.6 |
| LDLR | 244 | NM_000527.4 |
| LDLR (mouse) | 245 | NM_010700.3 |
| MLXIPL | 246 | NM_032951.2 |
| MLXIPL (mouse) | 247 | NM_021455 |

Example 9

C/EBPα-saRNA Regulates Pluripotency

Figure 23:
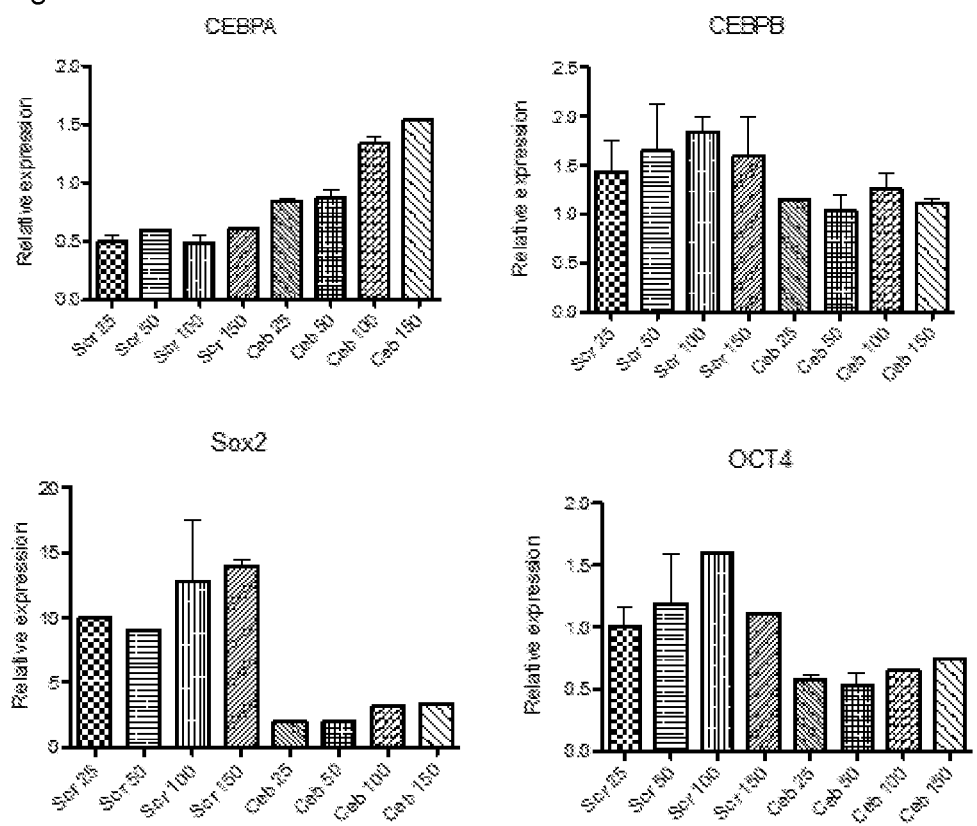
FIG. 23: C/EBPα, C/EBPβ, and 'self renewal' transcription factors relative expression levels following C/EBPα-saRNA transfection.

C/EBPα-saRNA of the present invention was administered to CD34+ stem cells and the relative expressions of C/EBPα, C/EBPβ, pluripotency factors SOX2, OCT4, cKit, KLF4, and NANOG were measured after transfection of C/EBPα-saRNA of different concentrations (25 nM, 50 nM, 100 nM or 150 nM) (FIG. 23 and FIG. 24). The relative expressions of C/EBPβ, SOX2, OCT4, cKit, KLF4 were reduced, while C/EBPα and NANOG expression increased. Therefore, C/EBPα-saRNA is able to regulate the core regulatory circuitry of stem cells that controls the self-renewal and pluripotency properties of stem cells.

| Gene | SEQ ID | Ref SEQ ID |
|---|---|---|
| SOX2 | 214 | NM_003106 |
| OCT4 | 215 | NM_001173531 |
| cKit | 216 | NM_000222 |
| KLF4 | 217 | NM_004235 |
| NANOG | 218 | NM_024865 |

Example 10

C/EBPα-saRNA Regulates C/EBPα Protein Isoforms

The C/EBPα mRNA generates two different translational isoforms by using different start codons within the same open reading frame: the full length 42 kDa protein and a 30 kDa truncated form. The 30 kDa isoform lacks an N-terminal transactivating domain (TAD1), but still retains its central transactivating domain (TAD2). These isoforms have different functions in gene activation and cell proliferation. Both isoforms can be detected within the cell and it is likely that the ratio of isoforms is important in mediating proliferation and differentiation control. [Calkhoven et al., *Genes and Development*, vol. 14, 1920-1932 (2000); Ramji et al., *Biochem J.*, vol. 365 (Pt 3), 561-575 (2002), the contents of which are incorporated herein by reference in their entirety].

To study the effect of C/EBPα-saRNA on the isoform ratio, HepG2 cells were transfected with 50 nM of C/EBPα-saRNA (AW1) or 20 nM of C/EBPα-siRNA with scramble oligonucleotides (siRNA and saRNA) as negative controls. Cells were transfected three times at 0 hrs, 24 hrs and 48 hrs. Cells were harvested at 72 hrs for total protein extraction. A Bradford assay was performed to normalize total protein loaded onto a sodium-dodecyl-sulphate polyacrylamide gel for separation by electrophoresis. The separated proteins were then immobilized onto nitrocellulose for a Western blot to detect protein expression of C/EBPα and C/EPβ. A stand antibody that recognizes the N-terminal domain of proteins (Antibody clone EP708Y, Millipore®) was used to detect any of the isoforms. Results show that endogenous levels of C/EBPα appear to be expressed predominantly as the 30 kDa variant in untransfected and scramble transfected cells. C/EBPα-saRNA transfection caused expression of a 42 kDa isoform of C/EBPα. This was then repressed in cells transfected with C/EBPα-siRNA. Endogenous C/EBPβ levels of the 34 kDa variant (defined as LAP, Liver Activated Protein) appear to be the predominantly expressed form in untransfected or scramble transfected cells. Transfection of C/EBPα-saRNA causes predominant expression of the 30 kDa variant (defined as LIP, Liver Inhibitory Protein). Expression of LIP was repressed in C/EBPα-siRNA transfected cells.

In another study, HepG2 cells were transfected with 50 nM of C/EBPα-saRNA (AW1 and AW2) or 20 nM of C/EBPα-siRNA with scramble oligonucleotides (siRNA and saRNA) as negative controls. An antibody that only recognizes the 42 KDa C/EBPα isoform (Cell Signaling Antibody #2843, Cell Signaling Technology®) was used instead of the standard antibody used in the study above. Western Blot results confirmed the 42 KDa C/EBPα isoform is upregulated by activating the C/EBPα gene. AW1 and AW2 both increased the 42 KDa C/EBPα isoform expression, indicating that the upregulation of the 42 KDa C/EBPα isoform might be gene specific and not sequence specific.

In another study, MCF7 cells are transfected with 50 nM C/EBPα-saRNA and 20 nM C/EBPα-siRNA with scramble oligonucleotides (siRNA and saRNA) as negative controls. Western blot is carried out to study the expressions of C/EBPα and C/EBPβ isoforms.

The studies above show that C/EBPα-saRNA modulates various C/EBPα and C/EBPβ isoforms. Not willing to be bound to any theory, the increase of the 42 kDa C/EBPα isoform might contribute to the novel anti-proliferation and other therapeutic effects of C/EBPα-saRNA.

| Protein | SEQ ID | Ref SEQ ID |
|---|---|---|
| C/EBPα 42kDa | 251 | NP_004355.2 |
| C/EBPα 30kDa | 252 | NP_001272758.1 |

Example 11

C/EBPα-saRNA and other C/EBP Family Members

HepG2 cells were seeded in normal RPMI/FBS/PSG media and transfected 2× doses with C/EBPα-saRNA with nanofectamine. Cells were harvested at 48 hours post C/EBPα-saRNA transfection and were analyzed for mRNA levels of C/EBPα, C/EBPβ, C/EBPγ, C/EBPδ and C/EBPζ. Concentrations of C/EBPα-saRNA employed were 50 nM, 100 nM, 200 nM and 250 nM. Cells transfected with scramble-saRNA were used as a control. Results show that the relative expression of all C/EBP family members increases after C/EBPα-saRNA and that the changes are dose dependent.

Furthermore, HepG2 cells were transfected 2× doses with siRNA inhibiting C/EBPα gene expression (C/EBPα-siRNA) with nanofectamine. With the knock-down of C/EBPα gene, the relative expression of other members of the C/EBP family was also inhibited. Concentration of C/EBPα-siRNA was 20 nM. Scramble siRNA was acquired from Invitrogen.

This study suggests that C/EBPα regulates the expression levels of the other members of the C/EBP family.

| Gene | SEQ ID | Ref SEQ ID |
|---|---|---|
| C/EBPα | 202 | NM_004364.3 |
| C/EBPα (mouse) | 220 | NM_007678.3 |
| C/EBPβ | 203 | NM_005194.3 |
| C/EBPγ | 204 | NM_005195.3 |
| C/EBPδ | 205 | NM_001252296.1 |
| C/EBPζ | 206 | NM_005760.2 |

Example 12

C/EBPα-saRNA in U87 Glioblastoma Cells

C/EBPα-saRNA was cloned into clinical retroviral replicating vector (RRV) in a miRNA configuration. The experiment investigated if the vector-miRNA configuration would work in combination with cytosine deaminase gene therapy in U87 glioblastoma cells. The retrovirus was expressing a double stranded sequence of C/EBPα-saRNA in a miRNA design, referred to as C/EBPα-miRNA, wherein the saRNA hairpin sequence was cloned into a miR-30 backbone flanking sequence. C/EBPα-miRNA might further comprise restriction enzyme recognition sequences. Non-limiting examples of restriction enzyme include NotI with a recognition sequence of GCGGCCGC and AscI with a recognition sequence of GGCGCGCC. One non-limiting example of C/EBPα-miRNA sequence is shown below and FIG. 26, wherein the microRNA is miR-30, C/EBPα-saRNA guide strand is AW1 antisense (SEQ ID No. 2) and passenger strand is AW1 sense (SEQ ID No. 1). C/EBPα-miRNA may be attached to a transgene so it can be co-expressed from an RNA pol II promoter. In this study, the C/EBPα-miRNA was attached to a green fluorescent protein gene (GFP). The GFP-C/EBPα-miRNA is expressed as a single transcript and the C/EBPα-miRNA is processed by Drosha and Dicer like an endogenous miR-30.

```
C/EBPα-miRNA sequence
                                    (SEQ ID No. 248)
UUGUUUGAAUGAGGCUUCAGUACUUUACAGAAUCGUUGCCUGCACAUCUU

GGAAACACUUGCUGGGAUUACUUCUUCAGGUUAACCCAACAGAAGGCUCG

AGAAGGUAUAUUGCUGUUGACAGUGAGCGCGGCGGUCAUUGUCACUGGUC

AUAGUGAAGCCACAGAUGUAUGACCAGUGACAAUGACCGCCUUGCCUACU

GCCUCGGAAUUCAAGGGGCUACUUUAGGAGCAAUUAUCUUGUUUACUAAA

ACUGAAUACCUUGCUAUCUCUUUGAUACAUU
```

In the results shown in FIG. 25, U87 cells were transfected with C/EBPα-saRNA (CAW1) or transduced with RRV-C/EBPα-miRNA (miCAW1) and C/EBPα mRNA transcript levels were measured by qPCR. Scrambled siRNA (con) and retrovirus vector delivering a small inhibitory hairpin against firefly Luciferase (mifLuc) were used as negative controls. On day 4, C/EBPα gene expression was up-regulated 1.5 fold with C/EBPα-saRNA transfection and 2 fold with the C/EBPα-miRNA vector transduction. Significant cell death was seen in C/EBPα-saRNA but not C/EBPα-miRNA. C/EBPα-miRNA may need more time to process.

Therefore, C/EBPα-saRNA may be cloned into a RRV in a miRNA configuration while still retaining its function to up-regulate C/EBPα gene expression in U87 cells.

Example 13

C/EBPα-saRNA in Human Studies

C/EBPα-saRNA-dendrimers were tested in clinical studies. Both strands of C/EBPα-saRNA have 2'-OMe-U modifications (mU) at 3'-terminus. Sequence and physical properties are shown below. Generation 4 (G4) diaminobutane (DAB)-core-PAMAM dendrimers (NanoSynthons LLC, Michigan) were used to form complexes with C/EBPα-saRNA. The ratio of C/EBPα-sRNA to DAB-core-PAMAM was 1:3 in weight. This C/EBPα-saRNA-dendrimer complex (MTL-501) was synthesized at the Synthetic and Biopolymer Chemistry Core, City of Hope Beckman Research Institute, Duarte Calif. This C/EBPα-saRNA-dendrimer complex is a lyophilized powder containing only the active ingredient is supplied as 50 mg per vial.

```
CEBPA AW-1 Sense:
                                    (SEQ ID No. 249)
5'-rCrGrG rUrCrA rUrUrG rUrCrA rCrUrG rGrUrC rArUmU-3'

CEBPA AW-1 Anti-sense:
                                    (SEQ ID No. 250)
5'- rUrGrA rCrCrA rGrUrG rArCrA rArUrG rArCrC rGrUmU-3'
```

Molecular Weight of CEBPA AW-1 Sense: 6641.0 g/mole
MOLECULAR WEIGHT: 6641.0 g/mole
EXTINCTION COEFFICIENT: 201800 L/(mole·cm)
nmole/OD$_{260}$: 4.96
μg/OD$_{260}$: 32.91
Molecular Weight of CEBPA AW-1 Anti: 6710.1 g/mole
WEIGHT: 6710.1 g/mole
EXTINCTION COEFFICIENT: 209600 L/(mole·cm)
nmole/OD$_{260}$: 4.77
μg/OD$_{260}$: 32.01

Figure 27:
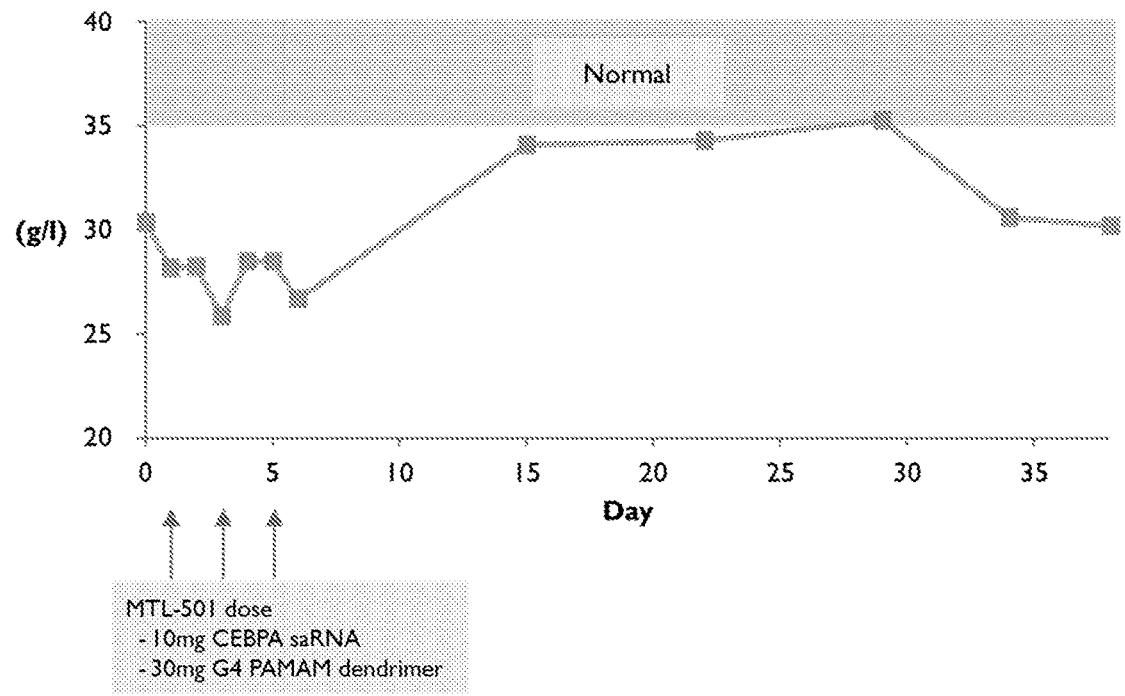
FIG. 27: Serum albumin levels in cirrhotic patients treated with MTL-501 (C/EBPα-saRNA-dendrimers).

The effect of C/EBPα-saRNA-dendrimer treatment was tested on cirrhotic patients. Cirrhotic patients have a depressed serum albumin level lower than the normal ranger of 35-40 g/l. This hypoalbuminemia is caused by decreased synthesis by hepatocytes and water and sodium retention that dilutes the content of albumin in the extracellular space. The administration of albumin protein to cirrhotic patients is widely used to improve liver and renal function and to decrease circulatory dysfunction [Lee, *Korean Journal of Internal Medicine*, vol. 27(1), 13-19 (2012); Bernardi et al., *Critical Care*, vol. 16, 211-217 (2012)]. In this study, three doses of C/EBPα-saRNA-dendrimer MTL-501 were given to cirrhotic patients in day 1, day 3, and day 5 at about 0.5 mg/kg. Serum albumin levels were measured until day 38 as shown in FIG. 27. A significant increase in serum albumin level was observed around day 15, when the serum albumin level increased to normal range. The serum albumin level maintained at normal range until day 34.

In another study, C/EBPα-saRNA-dendrimer was used to increase white blood cell count in cirrhotic patients. Three doses of C/EBPα-saRNA-dendrimer MTL-501 were given to cirrhotic patients in day 1, day 3, and day 5 at about 0.5 mg/kg. A single dose given to Patient 1 contained 10 mg C/EBPα-saRNA and 30 mg dendrimer. A single dose given to Patient 3 contained 20 mg C/EBPα-saRNA and 60 mg dendrimer. For both patients, an increase in white blood count was observed after first dose at day 2 and a bigger increase was observed at day 9 after 3 doses of C/EBPα-saRNA-dendrimer MTL-501 treatment.

The human study results suggest that C/EBPα-saRNA-dendrimer may be used as a therapeutic agent to treat patients with liver diseases and to increase white blood cell counts in patients in need thereof.

Example 14

Strand Selection/Identification and Cleavage Studies

Inverted abasic modifications at 5' terminus have been shown to prevent loading into the guide position in Ago2 complex. Antisense strand (AS) and sense strand (SS) of C/EBPA-saRNA were blocked with an inverted abasic modification at 5' end (b) and C/EBPA mRNA expression was measured and the impact of blocking AS and/or SS strands on C/EBPA mRNA expression was determined. All saRNA were synthesized and annealed in water. RP-HPLC has 90% purity. Sequences of the oligonucleotide samples were shown in the following table.

transcript is not required for CEBPA upregulation, although the up-regulation is less than positive control AW01-500000.

Example 15

C/EBPα-saRNA Upregulates ecCEBPA RNA and EST

Figure 29A:
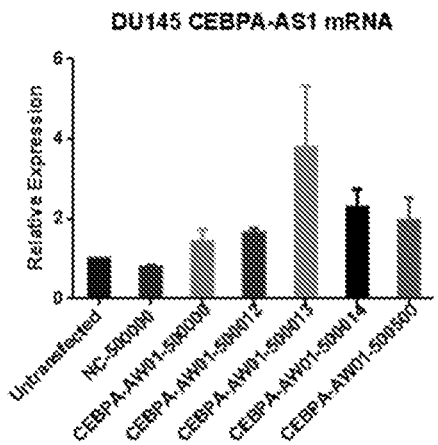
FIG. 29A-29E: Expression in DU145 cells.
Figure 29B:
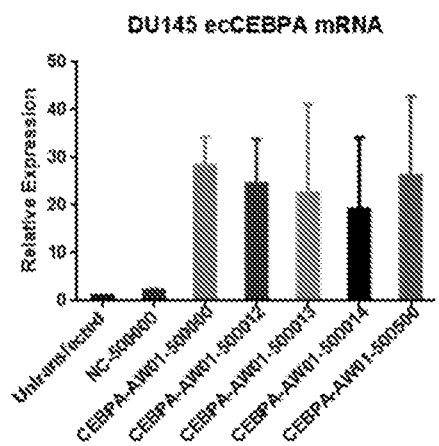
Figure 29C:
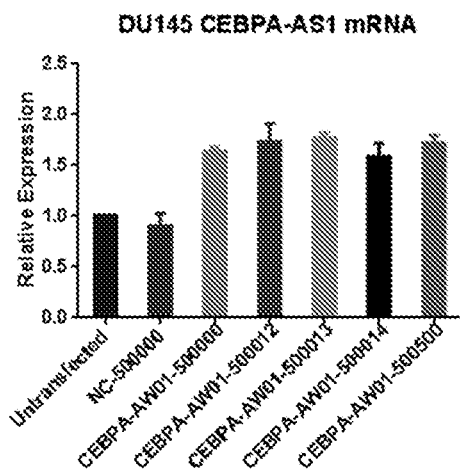
Figure 29D:
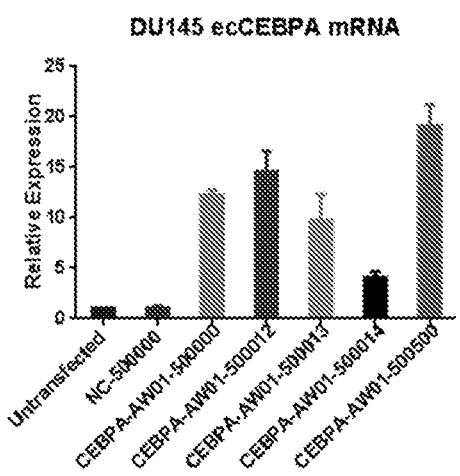

Extra coding CEBPA (ecCEBPA), a functional ncRNA transcribed from the CEBPA locus, regulates CEBPA methylation by interacting with DNA methyltransferase (DNMT1) thus preventing CEBPA gene methylation. It has been found that ecCEBPA knockdown led to a decrease of CEBPA mRNA expression and to a significant increase in DNA methylation (Ruscio et al., *Nature*, vol. 503:371-376 (2013) and US 20140171492 to Di Ruscio et al., the contents of each of which are incorporated herein by reference in their entirety). DU145 cells were transfected with oligonucleotides in Table 12 (above). The levels of ecCEBPA and CEBPA mRNA were measured and shown in FIG. 29A-29B (using 50 nM CEBPA-saRNA) and 29C-29D (using 10 nM CEBPA-saRNA). All the CEBPA-saRNAs upregulated both CEBPA mRNA and ecCEBPA except negative control (NC-

TABLE 12

Sequences of oligonucleotides used in the studies

| Oligo ID | Sequence (SS on top) | SEQ ID No. | Notes |
| --- | --- | --- | --- |
| NC-500000 | 5'-ACUACUGAGUGACAGUAGAUU-3'<br>3'-UUUGAUGACUCACUGUCAUCU-5' | 33<br>255 | Non-specific 'scramble' (negative control) |
| CEBPA-AW01-50000 | 5'-CGGUCAUUGUCACUGGUCAUU-3'<br>3'-UUGCCAGUAACAGUGACCAGU-5' | 256<br>257 | 'AW1' (positive control) |
| CEBPA-AW01-50001 | 5'-bCGGUCAUUGUCACUGGUCAUU-3'<br>3'-UUGCCAGUAACAGUGACCAGU-5' | 258<br>257 | Inverted abasic modification on SS only |
| CEBPA-AW01-50001 | 5'-CGGUCAUUGUCACUGGUCAUU-3'<br>3'-UUGCCAGUAACAGUGACCAGUb-5' | 256<br>259 | Inverted abasic modification on AS only |
| CEBPA-AW01-50001 | 5'-bCGGUCAUUGUCACUGGUCAUU-3'<br>3'-UUGCCAGUAACAGUGACCAGUb-5' | 258<br>259 | Inverted abasic modification on both SS and AS (negative control) |
| CEBPA-AW01-50050 | 5'-CGGUCAUUCAGACUGGUCAUU-3'<br>3'-UUGCCAGUAAGUCUGACCAGU-5' | 260<br>261 | Mutated central three base pairs |

Figure 28A:
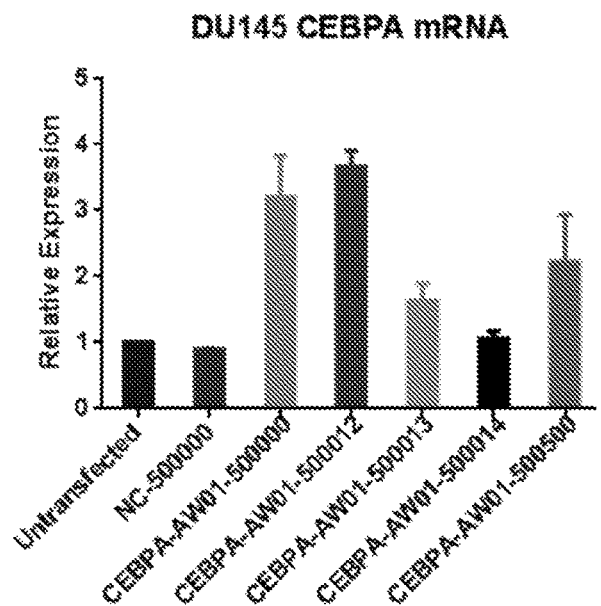
FIG. 28A-28F: Expression in DU145 cells.
Figure 28B:
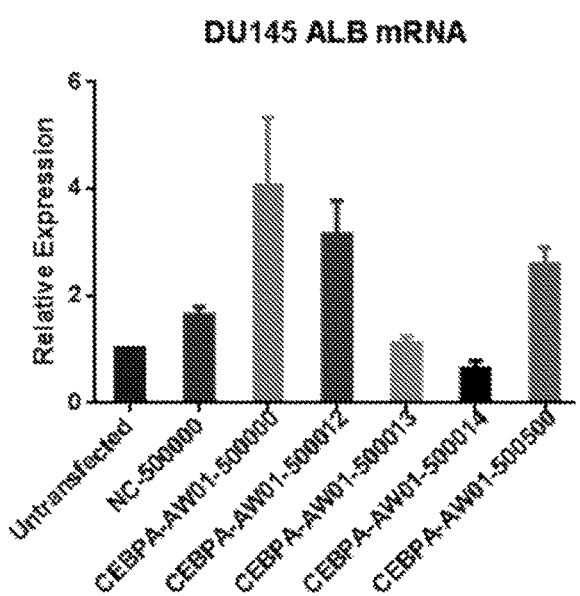
Figure 28C:
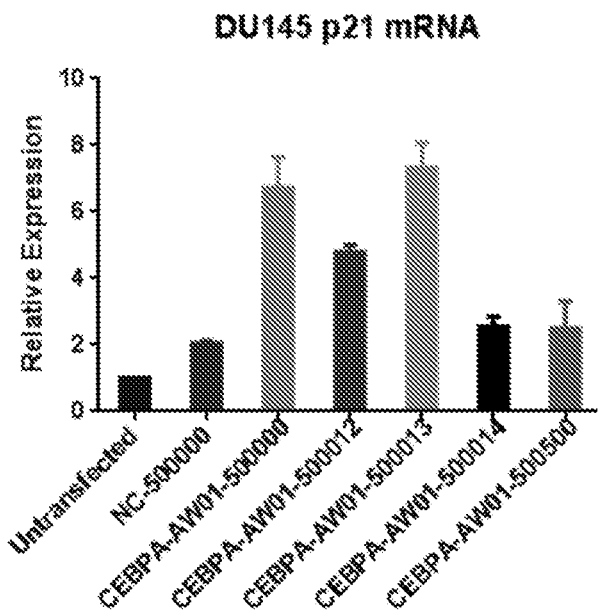
Figure 28D:
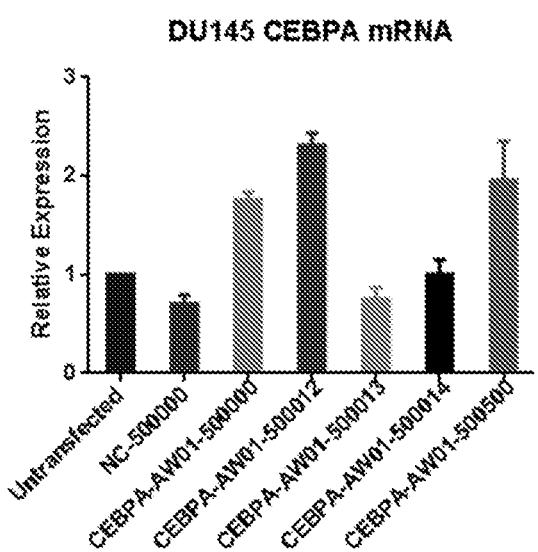
Figure 28E:
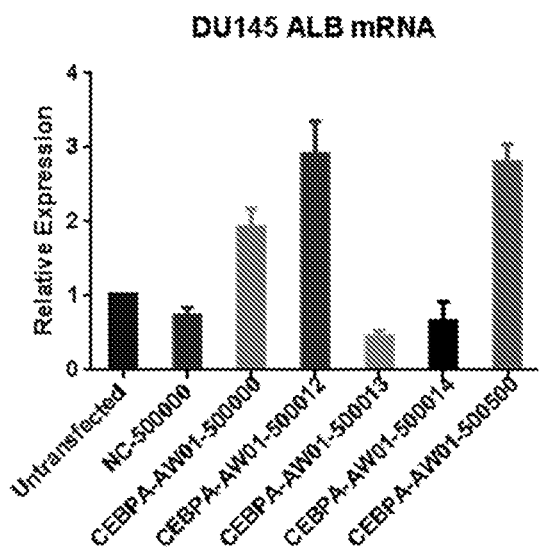
Figure 28F:
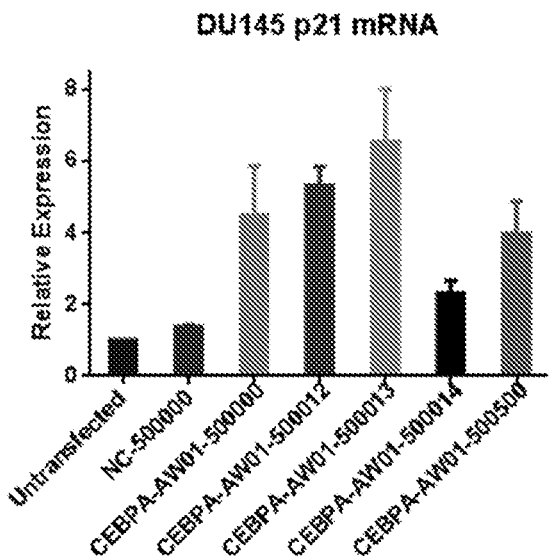

DU145 cells were reverse transfected with 50 nM oligonucleotide samples at seeding, forward transfected 24 hours later, and harvested at 72 hours. C/EBPA, ALB, and p21 mRNA expression levels were measured as shown in FIG. 28A-28C. The same study was carried out with 10 nM oligonucleotide samples and results were shown in FIG. 28D-28F. AW01-500012 acted similar to AW01-500000, showing blocking the SS does not affect upregulation. AW01-500013 and AW01-500014 acted similar to NC-500000, showing that blocking AS mutes upregulation. C/EBPA-saRNA acts through AS strand.

RNAi involves cleavage of target mRNAs. A non-cleaving sequence, mutations of central 3 base pairs, was tested (CEBPA-AW01-500500) to determine whether CEBPA-saRNA cleaves the target EST (AW665812). Mutation of the central 3 base pairs creates a non-cleavable saRNA, regardless of which strand serves as the guide. CEBPA-AW01-500500 is able to up-regulate CEBPA gene compared with negative control NC-500000, suggesting that cleaving of a 500000). At 10 nM, the double-abasic modified oligo (AW01-500014) showed less activation of ecCEBPA.

Figure 29E:
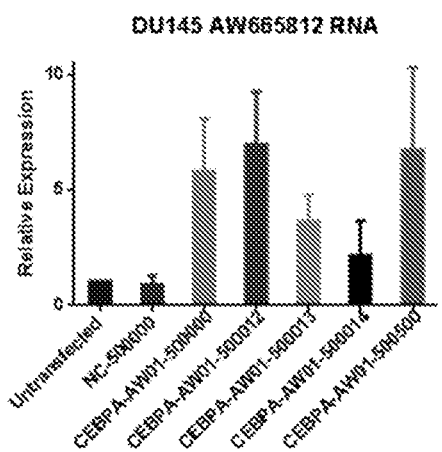

Furthermore, the levels of EST of CEBPA mRNA, AW665812, in DU145 cells were measured. DU145 cells were reverse transfected with 50 nM oligonucleotide in Table 12 (above) at seeding, forward transfected 24 hours later, and harvested at 72 hours. Results in FIG. 29E were from 2 repeats. Results in FIG. 29E showed that CEBPA-saRNAs upregulated EST instead of cleaving it.

Example 16

C/EBPα-saRNA Transfection Methods with a Reverse Transfection and a Forward Transfection A). HepG2 Cells
Materials Materials used in the studies included media: RPMI (Sigma, R8758/500ML) 1× Pen strep (Sigma P4333/100 ML) 10% FBS (Life 10082147); 24/well plates (Sigma Z707791/126EA); Lipofectamine 2000 (Life 11668027); TransIT/X2 (Mirus M6003); RNAiMAX (Life 13778030); Optimem 500 mL (Life 11058021); RNeasy Plus Mini Kit (Qiagen 74134); QuantiTect Rev. Transcription Kit (50, Qiagen 205311); Qiashredder 79654; MicroAmp® Optical Adhesive Film (Applied Biosystems, 4360954); MicroAmp® Fast Optical 384/Well Reaction Plate with Barcode, 0.1 mL (Applied Biosystems, 4346906); TaqMan® Fast Advanced Master Mix (1×5 mL, Life Tech 4444556); MicroAmp® Optical Adhesive Film (Life Tech 4360954); MicroAmp® Fast Optical 96/Well Reaction Plate with Barcode (Life Tech 4346906); 5 ml Serological PS Pipette (Sterile, Ind. Wrapped, 200/cs, USA Sci P/2837/5); 10 ml Serological PS Pipette (Sterile, Ind. Wrapped, 200/cs, USA Sci P/2837/10); 25 ml Serological PS Pipette (Sterile, Ind. Wrapped, 200/cs, USA Sci P/2837/25); 1000 ul tips (USA Sci 1111/2721); 200 ul tips (USA Sci 1111-0700); and 20 ul TipOne natural tip (USA Sci 1120-1810). Taqman® assays used in the experiment were CEBPA FAM/TAMRA Probe (Applied Biosystems, Hs00269972_s1) and GusB Endogenous Control VIC/TAMRA Probe (Applied Biosystems, Hs99999908_m1) AW1.

saRNA/siRNA used in the Experiment

Oligonucleotides used in the experiment included AW1 (CEBPA/AW01/500000), AW1/MM (CEBPA/AW01/500100), AW1/2OMe1 (CEBPA/AW01/500001), AW1/2OMe2 (CEBPA/AW01/500011), Scrambled 2OMe1 (NC/510003), and SMARTpool ON/TARGETplus CEBPA siRNA.

saRNA Handling

Oligonucleotides were rehydrated to 1 mM in 10 mM Tris/HCl, 20 mM NaCl2, 1 mM EDTA. This was accomplished by first adding the appropriate volume of 5× Annealing Buffer (50 mM Tris/Hcl; 100 mM NaCl2; 5 mM EDTA) followed by addition of RNase/free water. The misture was vortexed gently to complete rehydration. Equivalent volumes of AS and SS strands were mixed together by gentle vortexing. Tube with combined strands was placed in a beaker of milliQ/water at 95° C. (no boiling was allowed). The beaker was covered and water was allowed to cool to room temperature slowly. Aliquot annealed saRNA was stored at/20° C. Subsequent dilutions was performed using RNAse/free H2O.

HepG2 Maintenance

HepG2 cells were regularly passaged in RPMI supplemented with 10% Fetal Bovine Serum to maintain log phase growth. Cultures were discontinued when passage number exceeded 10.

Nucleic Acid/Lipofectamine Complex Formation

All reagents were brought to room temperature before proceeding. 1.5 ul Lipofectamine 2000 was added to 50 ul Optimem per transfection. saRNA was added to 50 ul Optimem for a final concentration of 50 nM. Diluted Lipofectamine and saRNAs were mixed gently and incubated for 5 minutes at room temperature.

Preparing HepG2 Cells for Transfection

Cells were detached with Trypsin/EDTA, triturated in an equal volume of growth medium and cell number was determined. Cells were centrifuged at 1000×g for 5 minutes and the cell pellet was resuspended in growth media so that 400 ul of growth media gave a 40% confluency in a well of 24 well plate. Nucleic acid/Lipofectamine complexation was gently added to cells and plated in a 24 well plate format. Final volume of cells, media and transfection complex was 500 ul. 24 hours later, cells should be around the 40%-45% confluency. Cells were retransfected 24 hours later, following same procedure for nucleic acid/Lipofectamine complexation but the complex was added to attached cells freshly fed with 400 ul growth media. Cells were fed 24 hours later with fresh growth media. RNA extraction was performed 24 hours after media change. All transfections were performed in triplicate. In summary, a reverse transfection was followed with a forward transfection.

Purification of Total RNA using RNeasy

Growth medium and lyse cells were aspirated in 350 ul RLT Buffer, pipetted several times and transferred to QIAshredder tube. They were then transferred through RNeasy spin column and wash steps were preformed per manufacturers protocol. Equal volume of 70% Ethanol was added to lysate and mixed thoroughly. Lysate/ethanol mixture was applied to a Filter Cartridge in a Collection Tube and spinned at 15,000×g for 30 seconds. Flow/through was discarded. 700 ul Wash Solution #1 was applied to Filter Cartridge and spinned at 15,000×g for 30 seconds. 500 ul Wash Solution #2/3 was added to Filter Cartridge and spinned at 15,000×g for 30 seconds. A second wash was repeated using Wash Solution #2/3. Flow/through was discarded and recentrifuged at 15,000×g for 30 seconds to remove residual traces of wash solution. Filter cartridge was placed into a fresh Collection Tube. 40 ul of Pipet Elution Solution was applied to center of filter. Cap of tube was closed. Eluate was recovered by centrifugation at 15,000×g for 30 seconds at room temperature.

RNA Quantification

RNA concentration was measured using a NanoDrop spectrophotometer.

Preparation of cDNA Archive

Equivalent amounts of RNA (between 500 ng to 2 µg) were used as input for each RT reaction. Amounts were determined after RNA extraction and quantification. All reactions were set up on ice to minimize the risk of RNA degradation. 1). RT Primer Mix and 5× Quantiscript RT Buffer were premixed in a 1:4 ratio if RT Primer Mix was used routinely for reverse transcription. 2). Any precipitates in gDNA Wipeout Buffer was dissolved by vortexing. 3). Template RNA was thawed on ice. gDNA Wipeout Buffer, Quantiscript Reverse Transcriptase, Quantiscript RT Buffer, RT Primer Mix, and RNase/free water were thawed at room temperature (15-25° C.). 4). The genomic DNA elimination reaction was prepared on ice according to Table 13. 5). The components were mixed and then stored on ice.

TABLE 13

Genomic DNA elimination reaction components

| Component | Volume/reaction | Final concentration |
| --- | --- | --- |
| gDNA Wipeout Buffer, 7× | 2 ul | 1× |
| Template RNA | Variable (up to 1 ug*) | |
| RNase-free water | Variable | |
| Total volume | 14 ul | — |

6). The mixture was incubated at 42° C. and then placed immediately on ice. 7). The reverse-transcription master mix was prepared on ice according to Table 14.

TABLE 14

Reverse-transcription reaction components

| Component | Volume/reaction | Final concentration |
|---|---|---|
| Reverse-transcription master mix | | |
| Quantiscript Reverse Transcriptase* | 1 ul | |
| Quantiscript RT Buffer, 5×†‡ | 4 ul | 1× |
| RT Primer Mix | 1 ul | |
| Template RNA | | |
| Entire genomic DNA elimination reaction (s3).) | 14 ul (added at step 5).) | |
| Total volume | 20 ul | — |

*Also contains RNase inhibitor.
†Include Mg2+ and dNTPs.
‡For convenience, PT Prime Mix and 5× Quantiscript RT Buffer may be premixed in a 1:4 ratio if RT Primer Mix is used routinely for reverse transcription. This premix is stable when stored at −20° C. 5 ul of the premix is used per 20 ul reaction.

8). Template RNA from step 3 (14 μl) was added to each tube containing reverse/transcription master mix. 9). The components were mixed and then stored on ice. 10). The mixture was incubated for 15 min at 42° C. 11). The mixture was incubated for 3 min at 95° C. to inactivate Quantiscript Reverse Transcriptase. 12). An aliquot of each finished reverse/transcription reaction was added to real/time PCR mix. 13). Reverse/transcription reactions were stored on ice and proceeded directly with real/time PCR, or for long/term storage, stored at −20° C.

Gene Expression Analysis

Quantitative PCR evaluation was used to measure relative gene expression by Taqman FAST qPCR on QuantStudio 7 Flex Real/Time PCR System. The volume of components needed to prepare the qPCR reaction plate was calculated using Table 14 below. Note: Additional reactions may be considered in the calculations to provide excess volume for the loss that occurs during reagent transfers.

Using a multichannel pipette, 6 uL of the reaction master mix was added to each well of a MicroAmp® Fast Optical 384/Well Reaction Plate. Using a multichannel pipette, 4 uL of cDNA from the cDNA archive reaction plates was added. The plate was sealed using MicroAmp Optical adhesive film. The plate was placed on ice until the thermal cycler is ready to load. All qPCR reactions were run in triplicate.

B). DU145 Cells

DU145 Culture Conditions:

Du145 cells grow more robustly when compared to HepG2. They are less susceptible to stress from trypsinisation or over-confluency. Routine media: RPM1649 (Sigma, R8758-500ML) supplemented with Pen/Strep/Glut (Sigma G1146) and 10% FBS (Life 10082147).

DU145 Seeding Density for Transfection:

Since DU145 cells have faster doubling rates than HepG2 cells, initial seeding density for transfection will be lower. For 24 well format: DU145=0.8×10⁵ cells/well; for 6 well format: DU145=200×10⁵ cells/well.

Transfection

Transfection of DU145 cells followed the same procedure as HepG2 cells: On the day of seeding into either 24 or 6 well format, the cells were subjected to a 'reverse transfection' step where lipofectamine 2000 based saRNA complexation in OptiMEM media was added to the cells before they adhered as a monolayer. After 24 hours, the media was replenished and thereafter a forward transfection step was performed. This was incubated for a further 24 hours prior to harvesting of cells for downstream application.

saRNA Handling:

Oligonucleotides were rehydrated to 1 mM in 10 mM Tris-HCl, 20 mM NaCl2, 1 mM EDTA. This was accomplished by first adding the appropriate volume of 5× Annealing Buffer (50 mM Tris-Hcl; 100 mM NaCl2; 5 mM EDTA) followed by addition of RNase-free water. Vortex was performed gently to complete rehydration. Equivalent volumes of AS and SS strands were mixed together by gentle vortexing. Tube with combined strands was placed in a beaker of milliQ-water at 95° C. (do not allow to boil). The beaker was covered and water was allowed to cool to room temperature slowly. Aliquot annealed saRNA was stored at −20° C. Subsequent dilutions was performed using RNAse-free H2O.

Nucleic Acid/Lipofectamine Complex Formation

All reagents were brought to room temperature before proceeding. 1.5 ul/3 ul (for 24 well/6 well plate) Lipofectamine 2000 was added to 50 ul/125 ul Optimem per transfection (for 24 well/6 well plate). saRNA was added to 50 ul/125 Optimem (for 24 well/6 well plate) for a final concentration of 50 nM. Diluted Lipofectamine and saRNAs were combined, mixed gently, and incubated for 15 minutes at room temperature.

Transfecting DU145 Cells

Cells were detached with Trypsin-EDTA, and excess amount of full media was added thereafter to deactivate trypsin. If necessary the cell number is determined using a hemocytometer. Cells were plated at the appropriate seeding density. Nucleic acid/Lipofectamine complexation was gently added to cells by dispensing as droplets and swirling the addition with the tip immersed in the buffer. 24 hours later, cells should be around the 40%-50% confluency. Cells were retransfected 24 hours later, following same procedure for nucleic acid/Lipofectamine complexation but the complex was added to attached cells freshly fed with 400 ul growth media—a forward transfection. Cells were retransfected again 24 hours later, using the same forward transfection technique used in the previous step. RNA extraction was performed 24 hours after third transfection.

Example 17

Modification Screen of C/EBPα-saRNA

Figure 30:
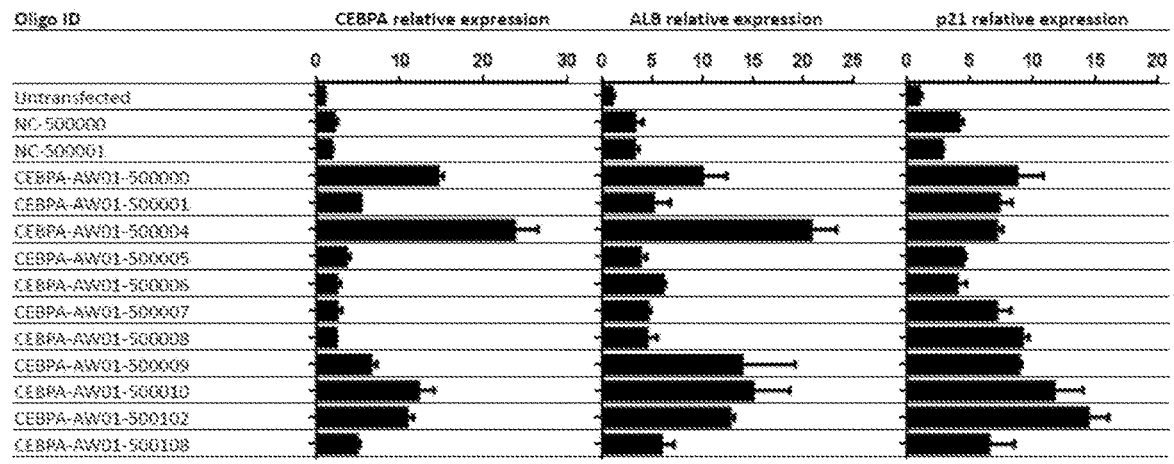
FIG. 30 shows CEBPA, ALB, p21 relative expression levels in DU145 cells after transfection with modified C/EBPα-saRNA.
Figure 31A:
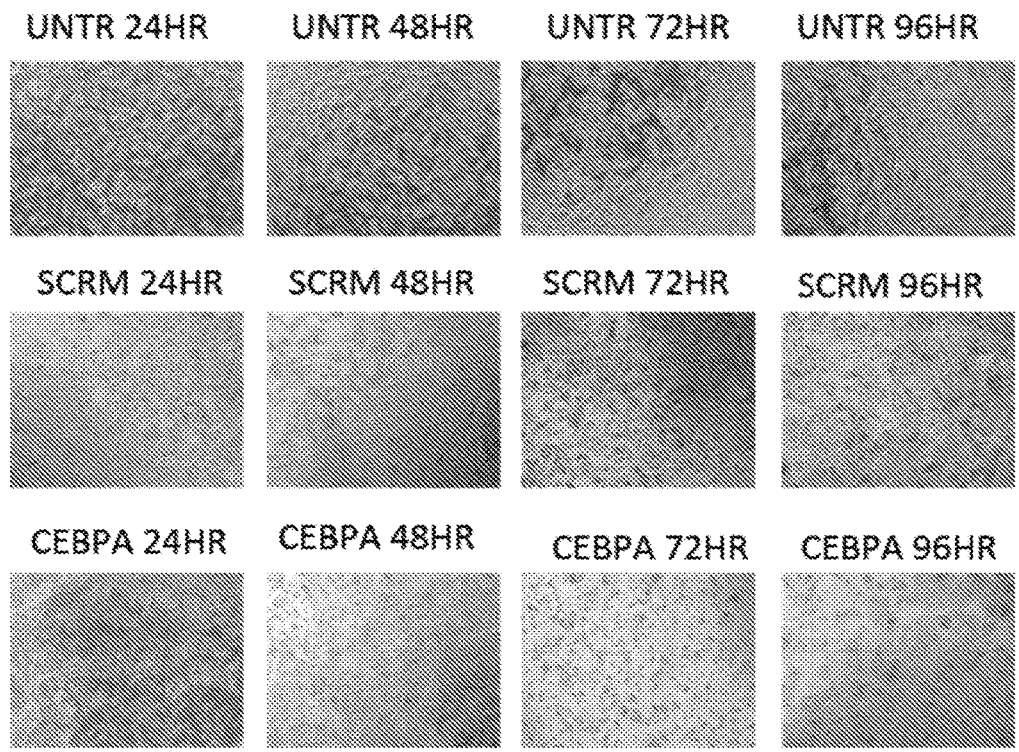
FIG. 31A-31G: Proliferation and time study.
Figure 31B:
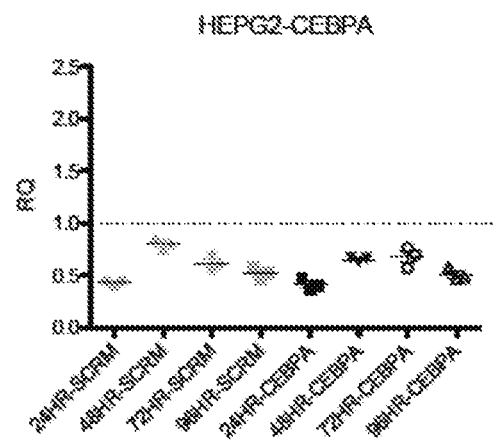
Figure 31C:
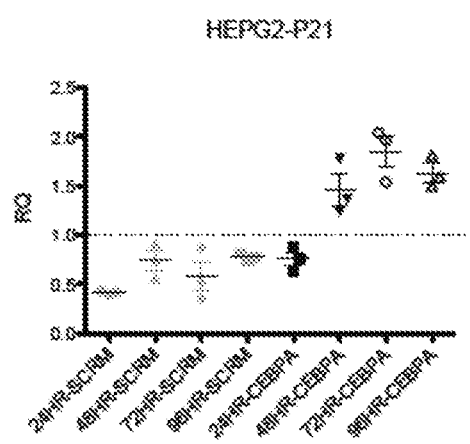
Figure 31D:
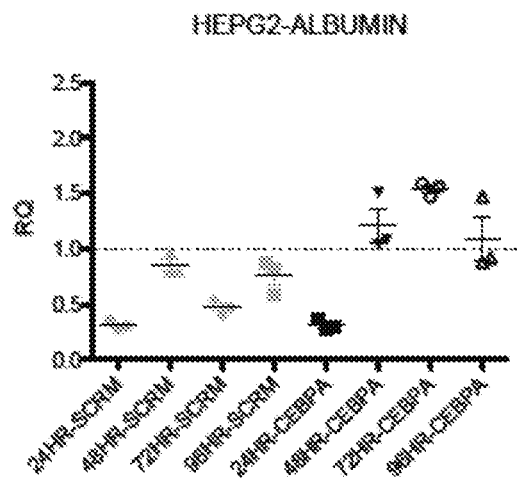
Figure 31E:
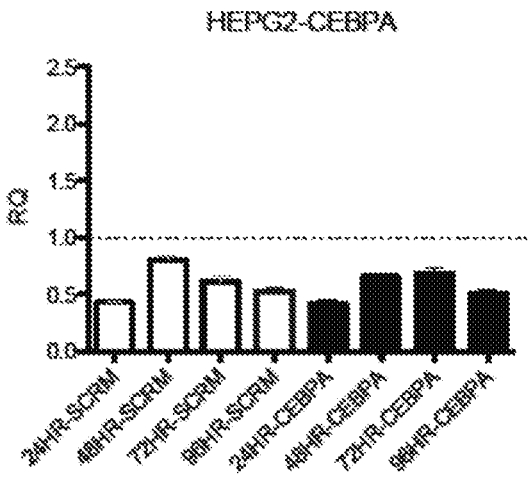
Figure 31F:
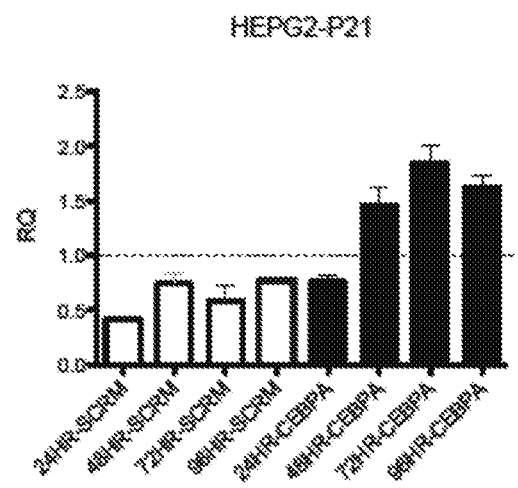
Figure 31G:
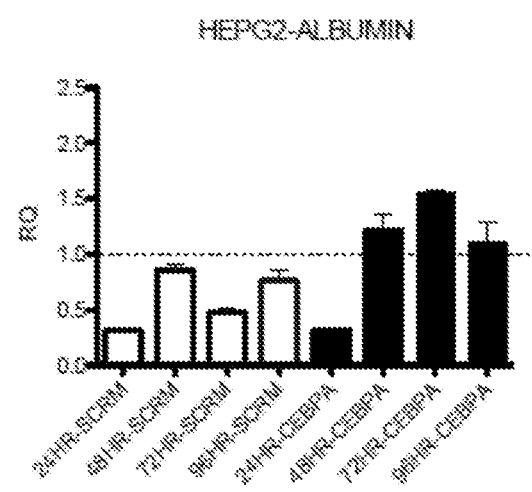
Figure 32A:
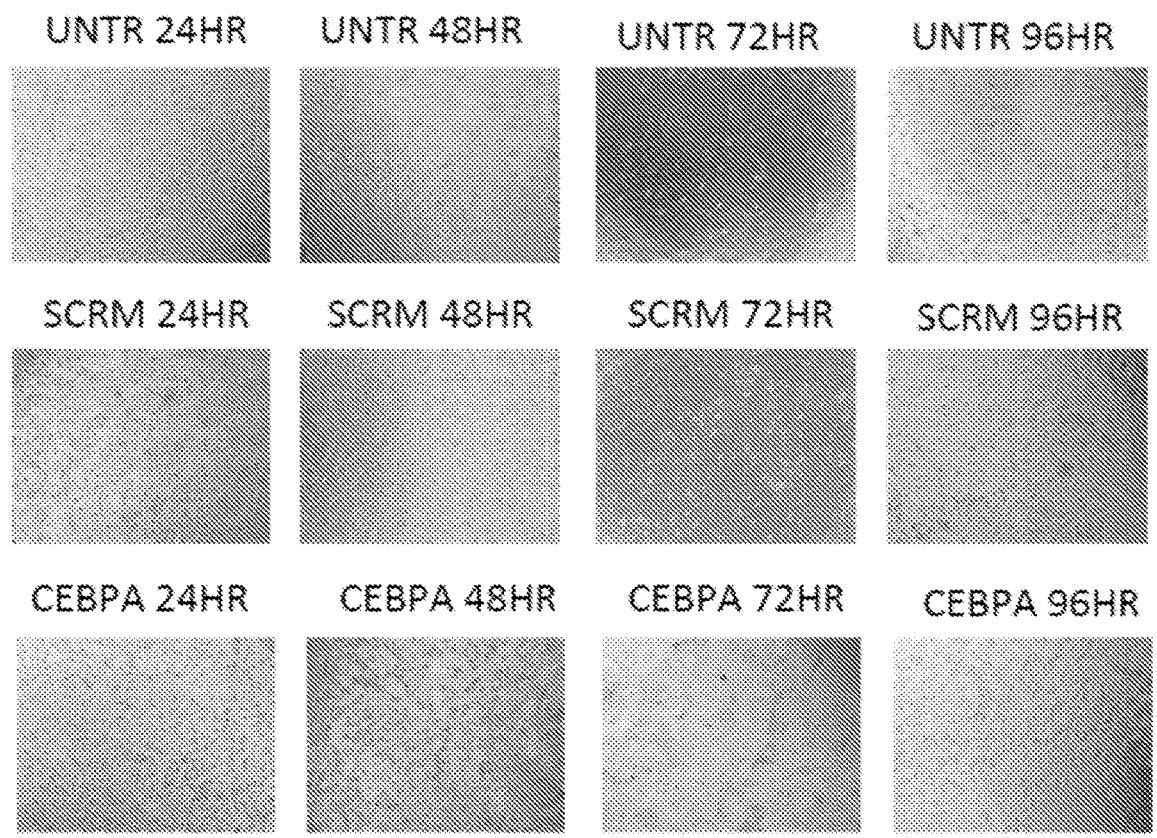
FIG. 32A-32G: Proliferation and time study.
Figure 32B:
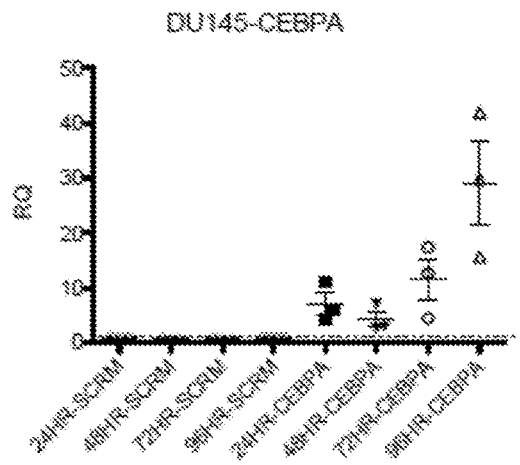
Figure 32C:
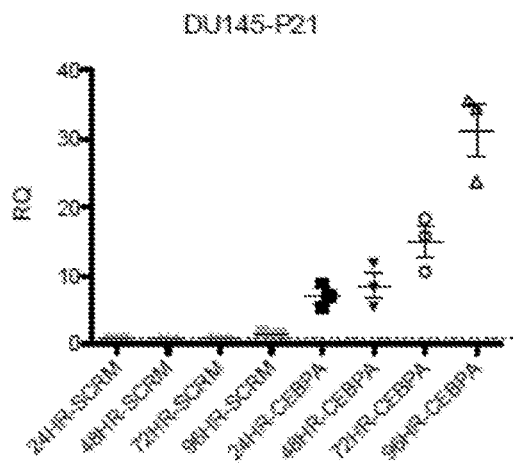
Figure 32D:
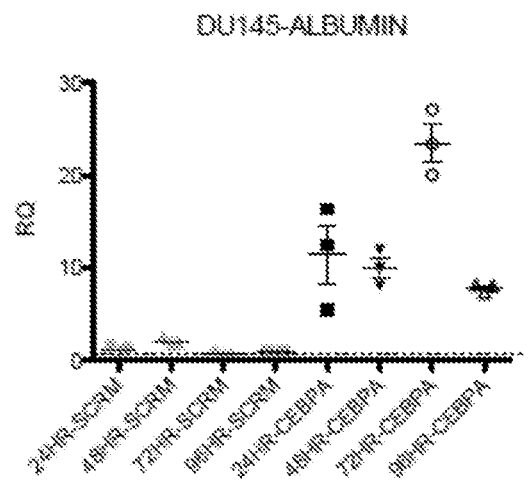
Figure 32E:
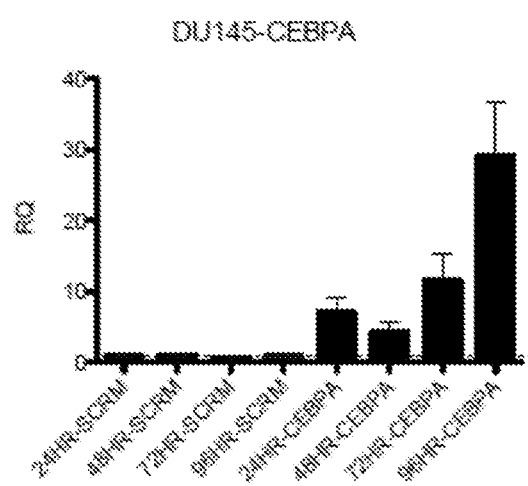
Figure 32F:
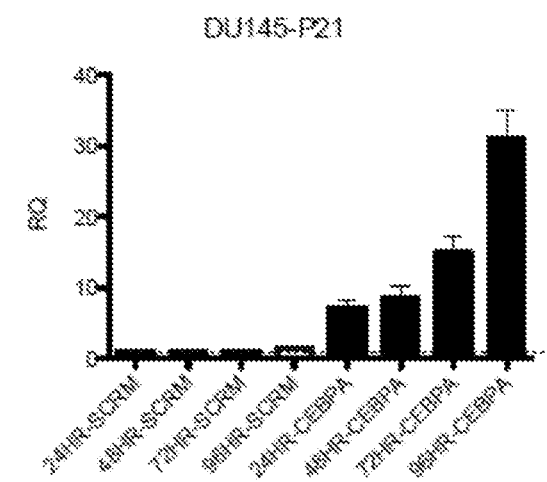
Figure 32G:
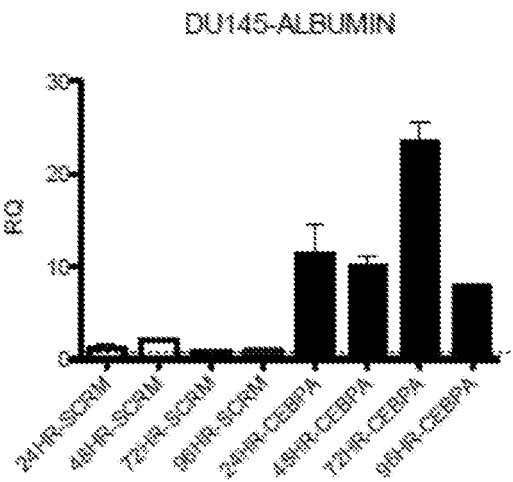
Figure 33A:
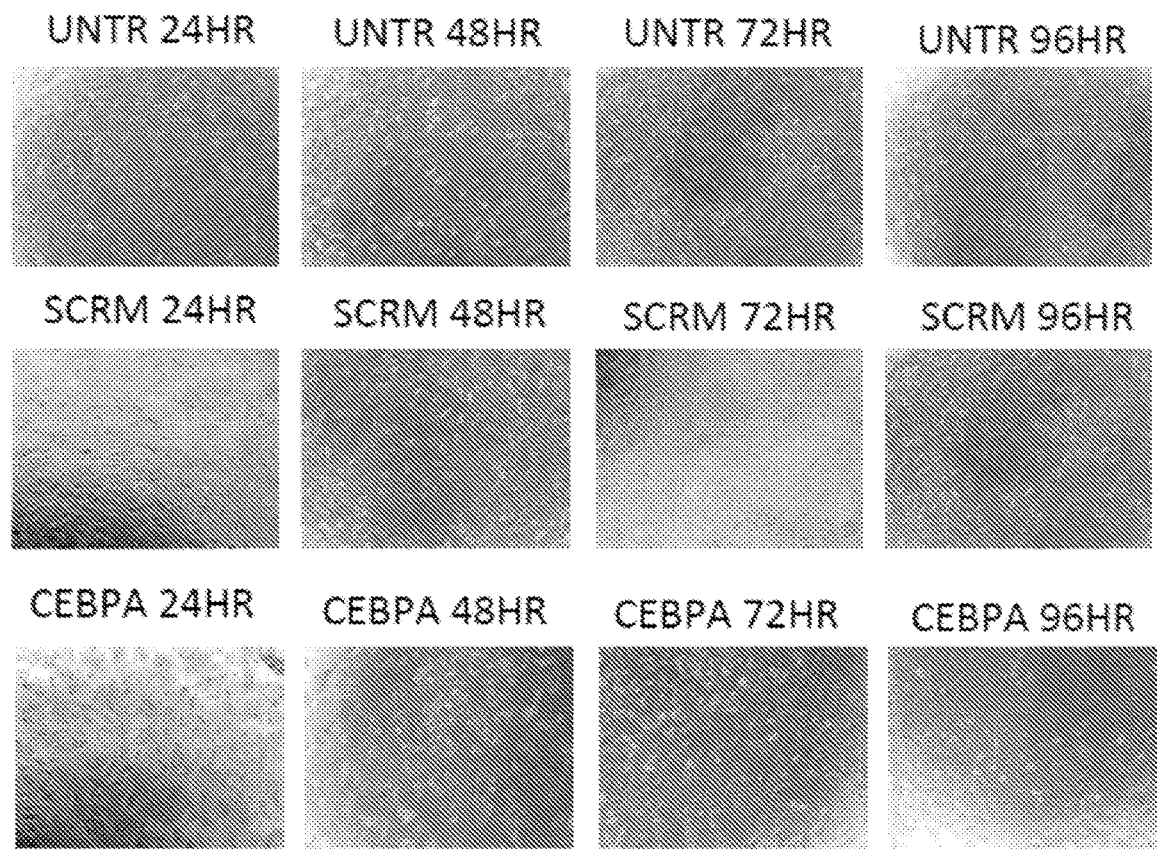
FIG. 33A-33G: Proliferation and formulation study.
Figure 33B:
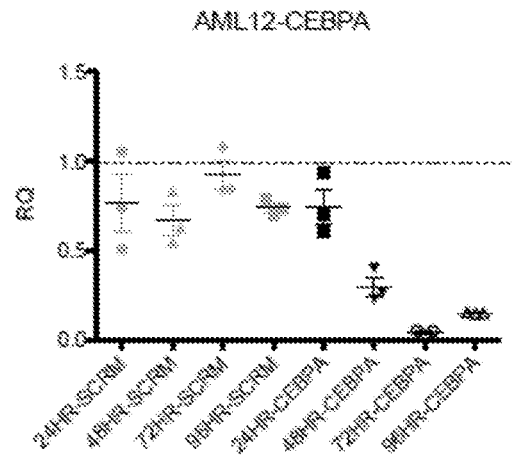
Figure 33C:
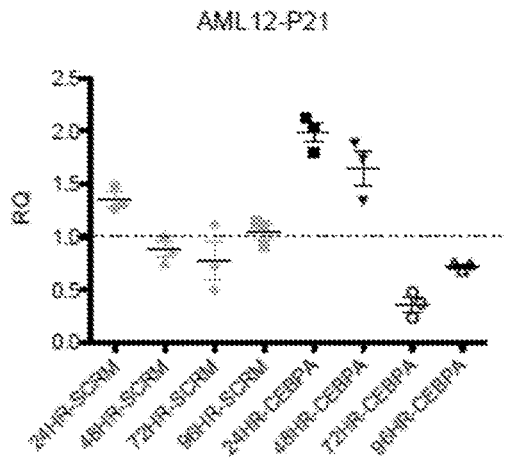
Figure 33D:
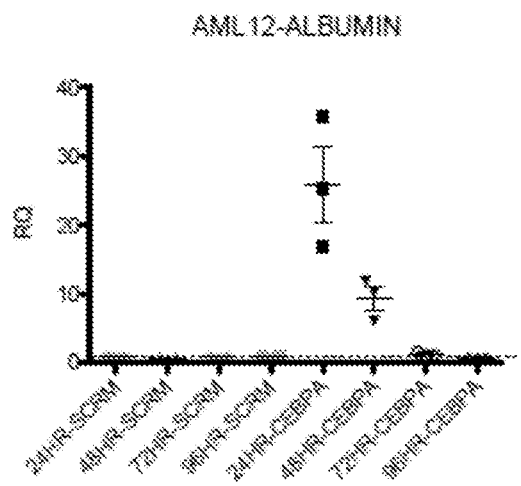
Figure 33E:
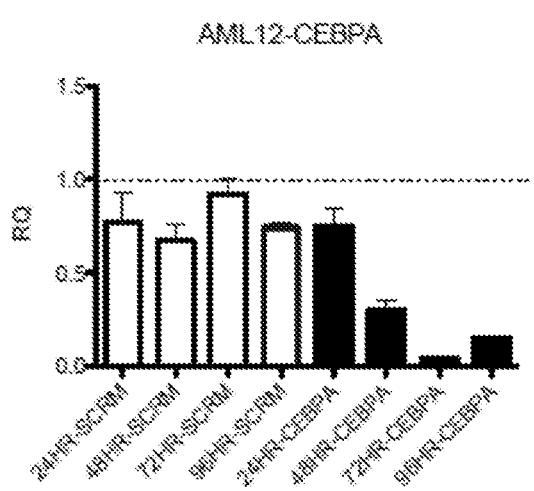
Figure 33F:
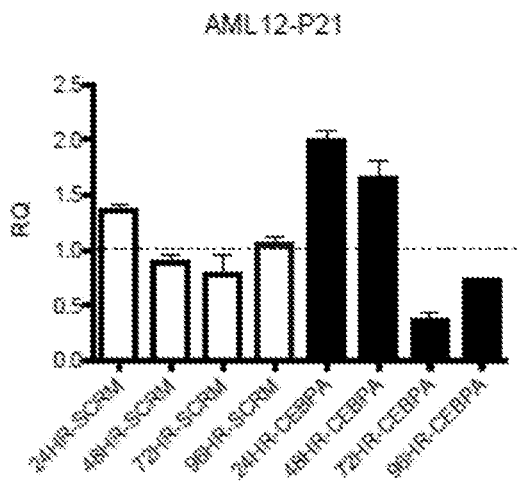
Figure 33G:
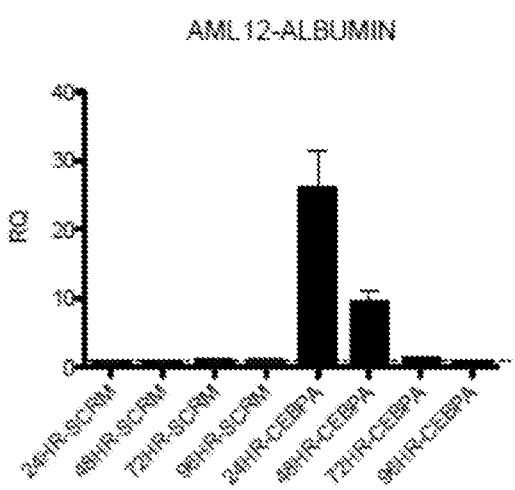
Figure 34A:
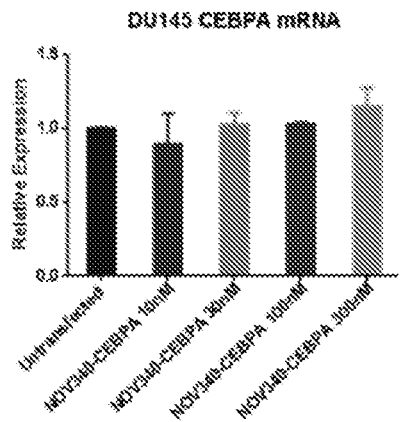
FIG. 34A-34F: Formulation study.
Figure 34B:
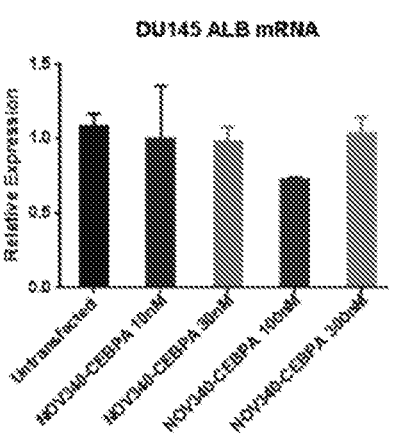
Figure 34C:
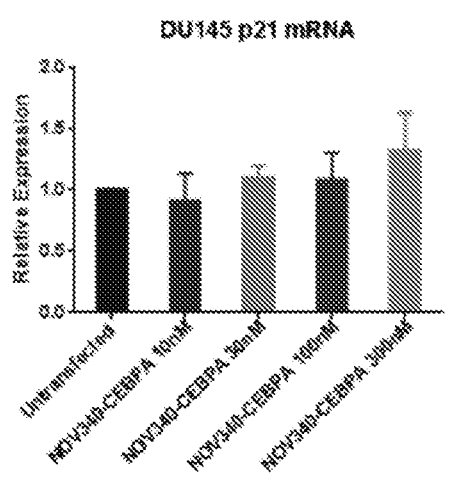
Figure 34D:
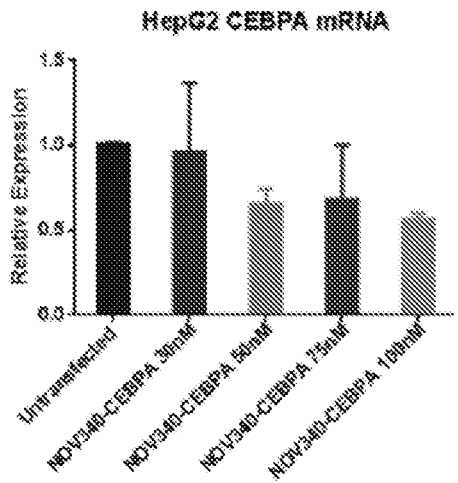
Figure 34E:
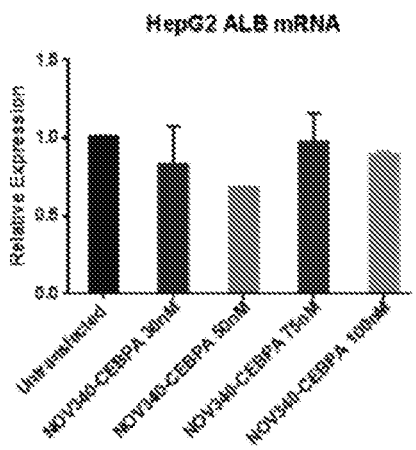
Figure 34F:
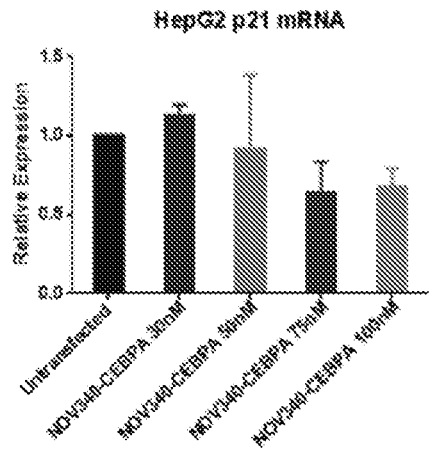

Modification screen studies were conducted with C/EBPα-saRNA having various modifications. Sequences of the oligonucleotide samples were shown in the following table. DU145 cells were reverse transfected with 50 nM oligonucleotides at seeding, forward transfected 24 hours later, and harvested at 72 hours. CEBPA, ALB, p21 relative expression levels were shown in FIG. 30. 2'O-Me modifications were better tolerated on SS. Mismatch in SS opposite 5' of AS increased potency of the saRNA.

TABLE 15

Sense sequences (m means 2'OMe modified)

| Oligo ID | SS sequence (5'→ 3') | SEQ ID No | Notes |
|---|---|---|---|
| NC-500000 | ACUACUGAGUGACAGUAGAUU | 33 | Unmod non-specific control |

TABLE 15-continued

| Oligo ID | Sequence | SEQ ID No | Notes |
|---|---|---|---|
| NC-500001 | ACUACUGAGUGACAGUAGAUmU | 262 | 2x OMe non-specific control |
| CEBPA-AW01-500000 | CGGUCAUUGUCACUGGUCAUU | 256 | Unmod AW1 |
| CEBPA-AW01-500001 | CGGUCAUUGUCACUGGUCAUmU | 249 | 2x OMe in vivo AW1 |
| CEBPA-AW01-500004 | CmGGmUCmAUmUGmUCmACmUGmGUCmAmUmU | 263 | SS: 11x OMe<br>AS: 2x OMe |
| CEBPA-AW01-500005 | CmGGmUCmAUmUGmUCmACmUGmGUCmAmUmU | 263 | SS: 11x OMe<br>AS: 11x OMe |
| CEBPA-AW01-500006 | CmGGUCAmUUmGUCACmUGmGUCAmUmU | 264 | SS: 7x OMe<br>AS: 7x OMe |
| CEBPA-AW01-500007 | mCGGmUmCAmUmUGmUmCAmCmUGGmUmCAmUmU | 265 | SS: 13x OMe<br>AS: 5x OMe |
| CEBPA-AW01-500008 | CGGmUCAmUmUGmUCACmUGGmUCAmUmU | 266 | SS: 8x OMe<br>AS: 5x OMe |
| CEBPA-AW01-500009 | CGGUCmAUUGUCACUmGGUCAmUmU | 267 | SS: 4x OMe<br>AS: 4x OMe |
| CEBPA-AW01-500010 | CGGmUCmAUUGUCACmUmGGUCAmUmU | 268 | SS: 6x OMe<br>AS: 2x OMe |
| CEBPA-AW01-500102 | CGGUCAUUGUCACUGGUCUmUmU | 269 | SS: 2x Ome + mismatch opposite 5' of AS<br>AS: 2x Ome |
| CEBPA-AW01-500108 | CGGmUCAmUmUGmUCACmUGGmUCUmUmU | 270 | SS: 8x Ome + mismatch opposite 5' of AS<br>AS: 5x Ome |

| Antisense sequences (m means 2'OMe modified) | | | |
|---|---|---|---|
| Oligo ID | AS sequence (5'→3') | SEQ ID No | Notes |
| NC-500000 | UCUACUGUCACUCAGUAGUUU | 255 | Unmod non-specific control |
| NC-500001 | UCUACUGUCACUCAGUAGUUmU | 271 | 2x OMe non-specific control |
| CEBPA-AW01-500000 | UGACCAGUGACAAUGACCGUU | 257 | Unmod AW1 |
| CEBPA-AW01-500001 | UGACCAGUGACAAUGACCGUmU | 272 | 2x OMe in vivo AW1 |
| CEBPA-AW01-500004 | UGACCAGUGACAAUGACCGmUmU | 273 | SS: 11x OMe<br>AS: 2x OMe |
| CEBPA-AW01-500005 | mUGmACCmAGmUGmACmAAmUGmACCmGmUmU | 274 | SS: 11x OMe<br>AS: 11x OMe |
| CEBPA-AW01-500006 | UmGACCmAGUmGACAAmUGACCmGmUmU | 275 | SS: 7x OMe<br>AS: 7x OMe |
| CEBPA-AW01-500007 | mUGACCAGmUGACAAmUGACCGmUmU | 276 | SS: 13x OMe<br>AS: 5x OMe |
| CEBPA-AW01-500008 | mUGACCAGmUGACAAmUGACCGmUmU | 276 | SS: 8x OMe<br>AS: 5x OMe |
| CEBPA-AW01-500009 | UGACCmAGUGACAAUmGACCGmUmU | 277 | SS: 4x OMe<br>AS: 4x OMe |
| CEBPA-AW01-500010 | UGACCAGUGACAAUGACCGmUmU | 273 | SS: 6x OMe<br>AS: 2x OMe |

TABLE 15-continued

| | | | |
|---|---|---|---|
| CEBPA-AW01-500102 | UGACCAGUGACAAUGACCGmUmU | 273 | SS: 2x Ome + mismatch opposite 5' of AS<br>AS: 2x Ome |
| CEBPA-AW01-500108 | mUGACCAGmUGACAAmUGACCGmUmU | 276 | SS: 8x Ome + mismatch opposite 5' of AS<br>AS: 5x Ome |

Example 18

C/EBPα-saRNA In Vitro Studies

A). HepG2 Cells

HepG2 cells were transfected with C/EBPα-saRNA using various methods. Expression of CEBPA transcript in HepG2 cells relative to untransfected HepG2 was measured thereinafter. Normal transfection (T), reserves transfection (RT), one dose (1), two doses (2) at 50 nM final concentration of saRNA were performed. Cells were harvested at 24 h, 48 h and 72 h. Results confirm reverse transfection (RT) is optimal compared to normal transfection (T). Optimal effect of saRNA was detected at 72 hours using both reverse transcription or normal transcription. Double transfection (2 doses, $2^{nd}$ transfection 24 hours subsequent to $1^{st}$ transfection) resulted in at least 4 fold increase.

B) Time Course Studies

HepG2, DU145 and AML12 cells were transfected with C/EBPα-saRNA (CEBPA-AW01-500000) for time course studies. Cells were seeded at 1.3×105 cells/well (8×104 cells for DU145) in a 24-well plate and reverse transfected, and then forward transfected 24 hours later. Medium was changed 4 hours after each transfection. Cells were harvested at 24, 48, and 72 hours post-seeding. CEBPA, ALB, Cyclin, and p21 mRNA levels were measured.

C). Comparison of HepG2, DU145 and AML12 with CEBPA-saRNA

HepG2 and AML12 seeding was 1.2×10⁵/well (24 well plate format). DU145 seeding was 0.8×10⁵/well (24 well plate format). Reverse transfection was performed at Day 0, forward transfection at Day 1. 24 hour time point=Day 3. 48 hour time point=Day 4. 72 hour time point=Day 5. 96 hour time point=Day 6. 50 nM of saRNA (scramble or CEBPA) was transfected. Media was changed every 24 hour. qPCR was performed to measure relative quantitation (baseline=untransfected). CEBPA, p21 and albumin expressions were measured. HepG2 data were shown in FIG. 31A-G, DU145 in FIG. 32A-G, and AML12 in FIG. 33A-G.

Example 19

Formulated C/EBPα-saRNA In Vitro and In Vivo Studies

A). Formulated CEBPA-saRNA In Vitro Transfection Analysis

CEBPA-saRNA was formulated in NOV340 (Marina). DU145 and HepG2 cells were reverse transfected with 10 nM, 30 nM, 100 nM and 300 nM of NOV340-CEBPA-saRNAs at seeding, forward transfected 24 hours later, and harvested at 72 hours. Results in FIG. 34A-34F showed no evidence of target engagement of direct target—CEBPA mRNA and proximal target—albumin mRNA and p21 mRNA.

B). Formulated CEBPA-saRNAs In Vivo Studies in Wild-Type Mice

CEBPA-saRNA was formulated in dendrimers—MTL-501 and NOV340 (Marina). Two in vivo studies were conducted in wild-type mice (n=5 in each study). Wild-type mice were given triple doses of dendrimer-CEBPA-saRNA and NOV340-CEBPA-saRNA and were sacrificed 2 days after the last dose Serum albumin and albumin mRNA levels were up-regulated, indicating proximal target engagement. However, there was no evidence of direct target engagement.

C). Formulated CEBPA-saRNA In Vivo Studies in DEN Rats

Figure 35A:
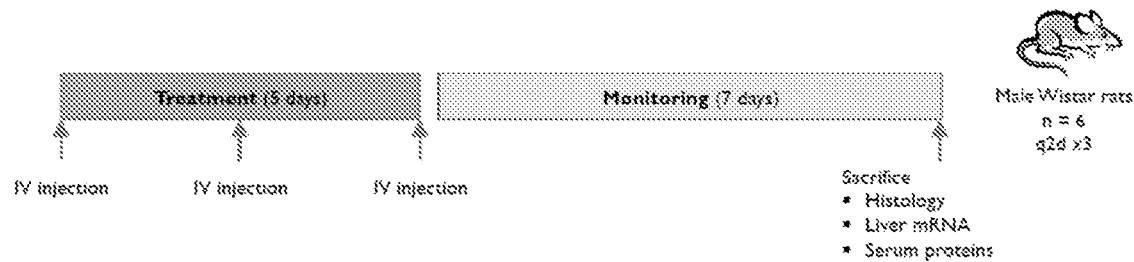
FIG. 35A-35F: Study design and outcomes.
Figure 35B:
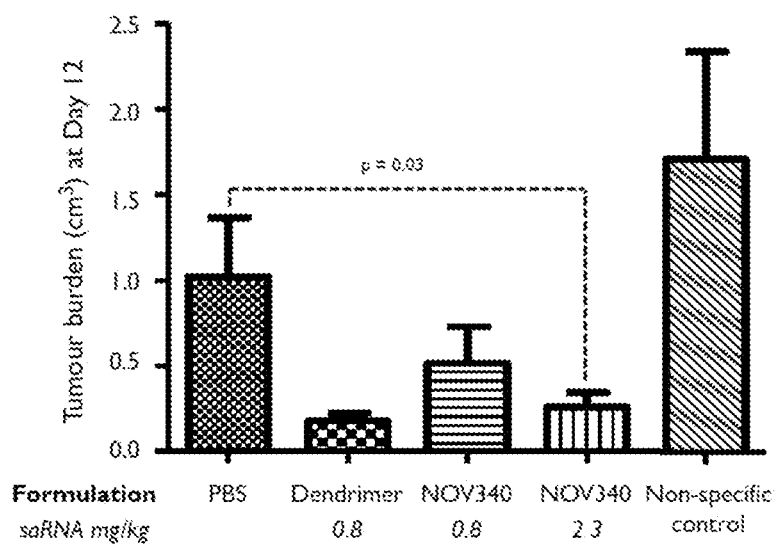
Figure 35C:
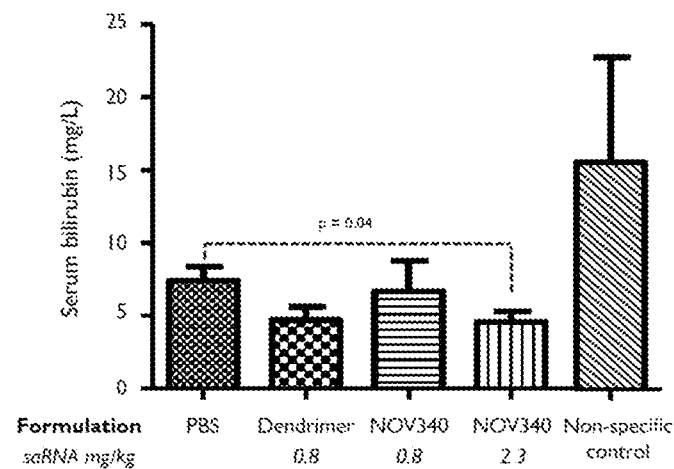
Figure 35D:
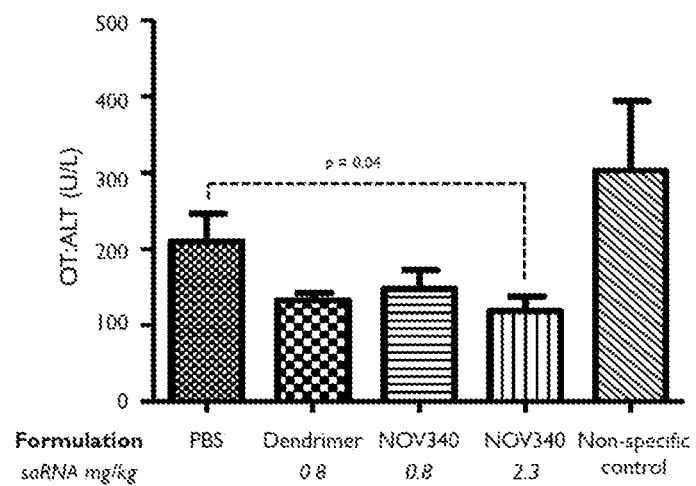
Figure 35E:
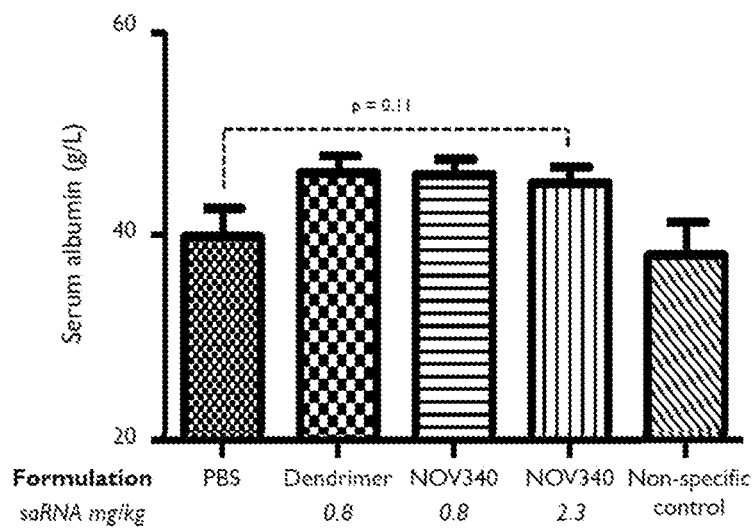
Figure 35F:
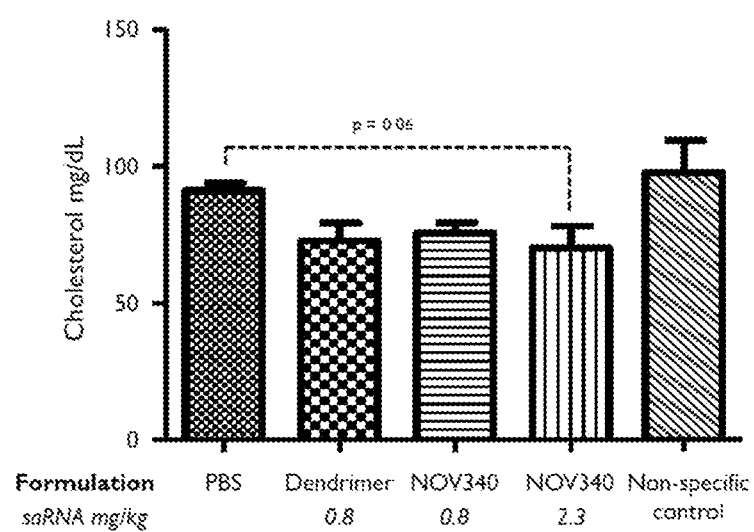

One in vivo study was conducted in DEN rats (n=6). HCC model induces liver cirrhosis and spontaneous liver tumors. Rats were fed diethylnitrosamine (DEN) for 7 weeks followed by water for 3 weeks. Treatment with various formulations of CEBPA-saRNA started immediately after tumor development. The rats received three IV injections in 5 days, followed monitoring for 7 days (FIG. 35A). They were then sacrificed for histology and measurements of liver mRNA and serum proteins. Tumor burdens at day 12 were shown in FIG. 35B. Serum bilirubin levels at day 12 were shown in FIG. 35C. ALT liver enzyme levels were shown in FIG. 35D. Serum albumin levels were shown in FIG. 35E. Cholesterol levels at day 12 were shown in FIG. 35F. CEBPA up-regulation, strong inhibition of tumor growth, improvement in liver function (serum bilirubin and ALT) and improved liver metabolism (serum cholesterol) have been observed.

Example 20

Formulated C/EBPα-saRNA In Vivo Comparisons

A). Wild Mice

CEBPA-saRNA was formulated in dendrimers—MTL-501 and NOV340 (Marina)-CEBPA/NOV340. The formulations were administered to wild type mice. Albumin was upregulated by MTL-501 and CEBPA/NOV340. CEBPA and albumin mRNA levels were measured. Total RNA was extracted and 500 ng was reverse transcribed. The results further confirmed that CEBPA and albumin were upregulated by MTL-501 and CEBPA/NOV340. Different dose levels of CEBPA/NOV340 (0.5 mg/kg and 3 mg/kg) were also administered to wild type mice.

B). DEN Rats

CEBPA-saRNA was formulated in dendrimers—MTL-501 and NOV340 (Marina)-CEBPA/NOV340. The formulations were administered to DEN rats using the same method as described in Animal experiments. Body weight, liver weight, tumor volume of DEN rats were shown in Table 16 below. Tumor volumes reduced significantly for all formulations/doses.

TABLE 16

| | | Body weight and liver weight of DEN rats | | | |
|---|---|---|---|---|---|
| | | body weight | liver weight | liver/body weight | average sd |
| PBS | PBS-1 | 430 | 24.8 | 0.058 | 0.067 |
| | PBS-2 | 385 | 22.6 | 0.059 | 0.011 |
| | PBS-3 | 400 | 32 | 0.080 | |
| | PBS-4 | 355 | 22 | 0.062 | |
| | PBS-5 | 420 | 33 | 0.079 | |
| saRNA + Dendrimer | R + D-1 | 420 | 25.4 | 0.060 | 0.054 |
| | R + D-2 | 440 | 25.6 | 0.058 | 0.005 |
| | R + D-3 | 425 | 22.8 | 0.054 | |
| | R + D-4 | 420 | 24 | 0.057 | |
| | R + D-5 | 400 | 19 | 0.048 | |
| | R + D-6 | 434 | 21.4 | 0.049 | |
| | R + D-7 | 450 | 22 | 0.049 | |
| NOV340 + saRNA 1 mg | N + R 1 mg-1 | 410 | 24.3 | 0.059 | 0.061 |
| | N + R 1 mg-2 | 425 | 24.4 | 0.057 | 0.004 |
| | N + R 1 mg-3 | 450 | 26 | 0.058 | |
| | N + R 1 mg-4 | 400 | 23.6 | 0.059 | |
| | N + R 1 mg-5 | 390 | 25.4 | 0.065 | |
| | N + R 1 mg-6 | 425 | 28 | 0.066 | |
| NOV340 + saRNA 3 mg | N + R 3 mg-1 | 430 | 23.2 | 0.054 | 0.055 |
| | N + R 3 mg-2 | 400 | 22 | 0.055 | 0.006 |
| | N + R 3 mg-3 | 425 | 24.2 | 0.057 | |
| | N + R 3 mg-4 | 430 | 23.6 | 0.055 | |
| | N + R 3 mg-5 | 385 | 25.6 | 0.066 | |
| | N + R 3 mg-6 | 410 | 21.4 | 0.052 | |
| | N + R 3 mg-7 | 396 | 18.5 | 0.047 | |
| SNALP-G + saRNA | S + R-1 | 420 | 28 | 0.067 | 0.058 |
| | S + R-2 | 400 | 23.4 | 0.059 | 0.005 |
| | S + R-3 | 415 | 24 | 0.058 | |
| | S + R-4 | 390 | 22.4 | 0.057 | |
| | S + R-5 | 395 | 22 | 0.056 | |
| | S + R-6 | 420 | 21.5 | 0.051 | |
| SNALP-G + scramble RNA | S + SC-1 | 390 | 24.6 | 0.063 | 0.070 |
| | S + SC-2 | 400 | 29 | 0.073 | 0.010 |
| | S + SC-3 | 405 | 28.4 | 0.070 | |
| | S + SC-4 | 405 | 24.4 | 0.060 | |
| | S + SC-5 | 410 | 35 | 0.085 | |

| | Total tumor volume of DEN rats | | |
|---|---|---|---|
| | | Total tumor volume(mm^3) | Average sd |
| PBS | PBS-1 | 391 | 1020.60 |
| | PBS-2 | 680.5 | 773.49 |
| | PBS-3 | 330.5 | — |
| | PBS-4 | 1733.5 | — |
| | PBS-5 | 1967.5 | — |
| saRNA + Dendrimer | R + D-1 | 378 | 177.36 |
| | R + D-2 | 94.5 | 116.67 |
| | R + D-3 | 64 | — |
| | R + D-4 | 157 | — |
| | R + D-5 | 236 | — |
| | R + D-6 | 64 | — |
| | R + D-7 | 248 | — |
| NOV340 + saRNA 1 mg | N + R 1 mg-1 | 1500 | 515.08 |
| | N + R 1 mg-2 | 331.5 | 521.01 |
| | N + R 1 mg-3 | 94.5 | — |
| | N + R 1 mg-4 | 236 | — |
| | N + R 1 mg-5 | 680.5 | — |
| | N + R 1 mg-6 | 248 | — |
| NOV340 + saRNA 3 mg | N + R 3 mg-1 | 32 | 261.00 |
| | N + R 3 mg-2 | 330.5 | 213.49 |
| | N + R 3 mg-3 | 248 | — |
| | N + R 3 mg-4 | 64 | — |
| | N + R 3 mg-5 | 680.5 | — |
| | N + R 3 mg-6 | 236 | — |
| | N + R 3 mg-7 | 236 | — |
| SNALP-G + saRNA | S + R-1 | 680.5 | 306.17 |
| | S + R-2 | 236 | 220.95 |
| | S + R-3 | 94.5 | — |
| | S + R-4 | 331.5 | — |

TABLE 16-continued

|  | S + R-5 | 94.5 | — |
|---|---|---|---|
|  | S + R-6 | 400 | — |
| SNALP-G + scramble RNA | S + SC-1 | 1394 | 1708.40 |
|  | S + SC-2 | 4000 | 1408.39 |
|  | S + SC-3 | 1967.5 |  |
|  | S + SC-4 | 500 |  |
|  | S + SC-5 | 680.5 |  |

Example 21

C/EBPα-saRNA Mechanism of Action Studies

Experiments are conducted to study C/EBPA-saRNA mechanism of action.

1). Analysis of RNA/DNA Interaction Using Chromatin Immunoprecipitation (ChIP) Enriched Genomic DNA Using Anti-Biotin Polyclonal Antibody:

C/EBPα-saRNA and scramble-saRNA were labeled with biotin. HepG2 cells were transfected with Biotin-Sramble-saRNA or Biotin-C/EBPA-saRNA. Cells were fixed with 1% formaldehyde to cross-link RNA/DNA complexes. Nuclear extracts were sonicated to shear genomic DNA to 200/300 bp fragments. Fragments were then immunoprecipitated using anti-biotin polyclonal antibody. The immune complex was then purified, reverse cross-linked and incubated with proteinase K. Remaining genomic DNA was purified using Phenol/Chloroform and screened for the presence of the following gene promoters: CEBPA, CDKN1A (p21), AFP, NAB1 (Negative control), IGX1A (EpiTect ChIP negative control Qiagen).

Figure 36A:
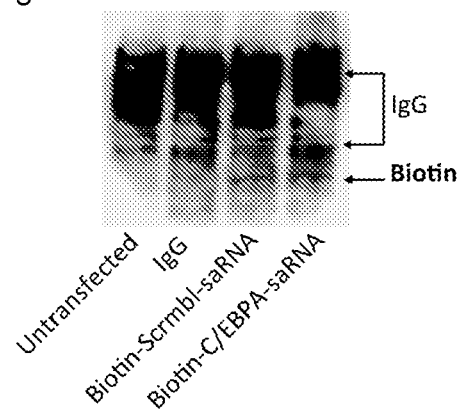
FIG. 36A-36B: Western blots.
Figure 36B:
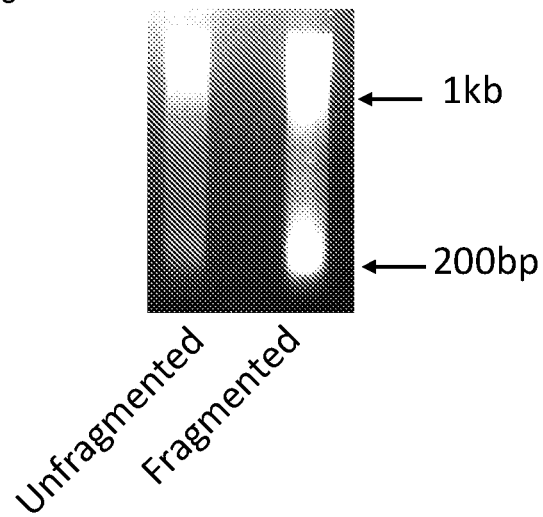

A western blot confirmed presence of biotin-labelled saRNA in transfected HepG2 cells. Transfected cell extracts were immunoprecipitated using anti-biotin polyclonal antibody. Results were shown in FIG. 36A. 1.5% Agarose gel electrophoresis to separate fragmented genomic DNA from transfected HepG2 cells as shown in FIG. 36B.

ChIP-Seq of biotin-labeled saRNAs was conducted to study which promoter regions saRNA is associating across the genome. Chromatin immunoprecipitated genomic DNA using anti-biotin was screened for presence of the TSS fragment of C/EBPA, AFP, CDKN1A and NAB1. IGX1A is the internal negative control for this assay to assess back ground. The ChIP-qPCR IGX1A negative control primer measures the amount of non-specific genomic DNA that co-precipitates during the ChIP procedure. IGX1A detects a specific genomic DNA sequence within an ORF-free intergenic region or "promoter desert" lacking any known or predicted structural genes on Human chromosome 12 Ref seq: NC_000012.11. Results show that only C/EBPA promoter region was present.

2). ChIP-Seq with anti Pol-II is conducted to identify regions of promoter activation and transcriptional activity. Other antibodies can be used for evidence of epigenetic changes, such as H3K4me3/H3KAc/H3K27me, etc.

3). RIP instead of ChIP-Seq in 1) and 2) is conducted to measure enrichment of saRNA and various proteins at ncRNA once they are identified.

4). ChIP-qPCR of H3K4Me3 is conducted to validate genes/promoters identified in 2). saRNAs are not biotin-labeled.

5). Experiments including strand-specific RT-PCR, RACE-PCR, and RNA-FISH are conducted for identification and characterization of potential antisense ncRNAs for C/EBPA promoter and any other off-target promoters identified above.

6). Cells are transfected with siRNA to all Ago proteins as well as C/EBPA-saRNA to identify which Ago are required for upregulating C/EBPA expression.

7). Cells are transfected with CRISPR to mutate target promoter sequence whilst not mutating translated protein to determine if saRNA is acting through on-target transcriptional regulation.

8). Directional RT-PCR shows strand specific transcripts at promoter region. Should be evidence of a ncRNA 9). Nuclear run is performed in order to study where transcriptional activity is occurring across genome. A ribosome blocker is also used to show any transcriptional off target effects of saRNA.

10). Cells are transfected with a gapmer targeted to ncRNA, e.g. CEBPA-AS1, to degrade the ncRNA. saRNA transfection and CEBPA upregulation are studied to determine if there is any impact when the ncRNA is degraded.

Example 22

CEBPA for Surgical Supportive Care

Animal Experiments

A clinically relevant rat cirrhotic model was used as described herein. Male Wistar rats (150-180 g) at 6 weeks of age were obtained from the Animal Center of National Taiwan University. The rats were housed in standard conditions, and all the experiments were conducted in accordance with the "Guide for the Care and Use of Laboratory Animals" prepared by the Institutional Animal Care and Use Committee of National Taiwan University. These animals were given diethylnitrosamine (DEN) solution (Sigma, St Louis, Mo.) daily as the sole source of drinking water for 9 weeks, starting with 100 ppm in the first week. The average BW of the animals was measured once a week and the concentration of DEN in their drinking water was adjusted in proportion to the BW each week relative to that of the first week. After 9 weeks of DEN administration, liver cirrhosis could be noted at that time. The rats were divided into three groups of ten, randomly. Group 1 received C/EBPa-saRNA treatment, group 2 received scramble-saRNA treatment and group 3 received PBS instead and served as control.

For in vivo therapy C/EBPa-saRNA was reconstituted with 100 uL of RNase/DNase free $H_2O$; 50 IL of 20 nM saRNA oligonucleotide and 50 uL of TEA core PAMAM dendrimer, previously described.

Ten cirrhotic animals were treated with 3× doses by way of tail vein injections in the first week. Control animals (n=10) were injected with an equal volume of phosphate-buffered saline (PBS) or scramble-saRNA.

7 days after the last saRNA-C/EBPα:Dendrimer injection, Partial (70%) hepatectomies were performed on all rats after midline laparotomy by means of aseptic removal of the median and left lateral lobes according to the procedure of Higgins and Anderson (Higgins G M and Andreson R M, "Experimental pathology of the liver: Restoration of the liver of the white rat following partial surgical removal", Arch. Pathol. vol. 12:186-202 (1931), the contents of which are incorporated herein by reference in their entirety). Briefly, an upper median incision was made on the abdomen with the animals in supine position under general anesthesia (ketamine 40 mg/kg i.p.), followed by mobilization of the median and left lobes of the liver through careful dissection on the surrounding ligaments. The median and left lobes were then ligated at the base and resected. The harvested hepatic tissue was then divided into several portions (labeled as samples on postoperative day 0, POD 0) for subsequent histological examination and immersed in 10% formalin, while the remainder was rapidly frozen in liquid nitrogen and stored at −80 "C. until needed for protein and molecular analyses to compare with the tissue obtained 2 week later when the animals were sacrificed (labeled as samples on postoperative day 7, POD 7) with $CO_2$ inhalation. The liver lobes resected during hepatectomy as well as those excised at the end of the follow-up period were were also weighed with the liver-to-body weight ratio verified (LW/BW×100%) for comparison. Change in liver weight was evaluated as the hepatic regeneration rate (RR). RR is defined as liver weight per 100 g of the body weight at euthanization/preoperative estimated liver weight per 100 g of the body weight (Anderson K J et al., "Postoperative but not preoperative treatment with sorafenib inhibits liver regeneration in rat", J Surg Res, vol. 191(2): 331-338 (2014), the contents of which are incorporated herein by reference in their entirety). The preoperatively estimated total liver weight was calculated from the resected liver weight (70% of preoperative total liver weight). In this model, the beginning of the process of reconstitution occurs after 12 to 16 hours, reaching the first peak of synthesis of DNA after 24 hours of the regenerative stimulus, followed by another less intense by 36 to 48 hours. The recovery of liver mass removed happens within two to three weeks.

Immunohistochemistry and Histological Staining.

For detecting the regeneration capacity of liver after partial resection, all rats were given a single IP injection of BrdU (Sigma; St Louis, Mo.) at a dosage of 100 mg/kg body weight at 2 hr before sacrifice on $7^{th}$ day after hepatectomy. Liver lobes that were resected during hepatectomy as well as those that were excised at the end of the follow-up period were fixed, paraffin embedded, and processed to 6 μm sections as follows. The immunostaining of BrdU was performed for post-hepatectomic livers. For staining of BrdU, sections were incubated with a monoclonal mouse anti-BrdU 1:100 (MO744 clone BU20A; DAKO Sweden AB) for 60 min, followed by incubation of the secondary antibody, a biotinylated polyclonal rabbit anti-mouse 1:400 (E0464; DAKO Sweden AB), for 25 min. Sections were then incubated with ABC vectastain standard kit (PK 6100; Vector Laboratories, Burlingame, Calif.) for 30 min and developed with DAB Impact (Vector Laboratories) substrate for 5 min. Sections were counterstained with hematoxylin (Mayers Hematoxylin; Histolab, Göteborg, Sweden). The labeling index of BrdU was calculated as the ratio between the positively stained hepatocyte nuclei, respectively, to the total numbers of hepatocytes. The cumulative mean value from 15 randomly counted fields of the sections was calculated under light microscopy (400×). For IHC demonstration of Ki-67 or Proliferating cell nuclear antigen (PCNA), tissue sections were quenched for endogenous peroxidase and placed in an antigen retrieval solution (0.01 M ci-trate buffer, pH 6.0) for 15 min in a microwave oven at 100 C at 600 W. After incubation in the casein block, Monoclonal mouse anti-rat Ki-67 specific antibody (clone MIB-5, isotype IgG1; Dako, Glostrup, Denmark) or mouse MAb anti-PCNA (clone PC10; DAKO) was applied to the sections at dilutions of 1:20 and 1:5000, respectively. Sections were incubated with the primary antibody for 4 days at 4° C. Sections were washed, positive signals were visualized using the EnVision+ horseradish peroxidase labelled antimouse detection system (Dako), and the sections were counterstained with haematoxylin, dehydrated, and mounted. The number of cells was counted in five different viewpoints per each slide and the ratio of PCNA or Ki-67 positive/total hepatocytes was calculated.

Biochemical Analysis of Serum

Immediately prior to hepatectomy and sacrifice, blood samples were collected by venous puncture and immediately centrifuged at 1300×g at 4° C., plasma was kept at −20° C. for biochemical analyses. Albumin, Alanine aminotranferease (ALT), aspartate aminotransferase (AST), total bilirubin and Gamma-glutamyl transpeptidase (γ-GT) levels were determined using commercial enzymatic kits with a automatic biochemistry analyzer (200FR; Toshiba, Japan). Blood levels before hepatectomy were stated as standard levels.

Results

As shown in Example 1, intravenous injection of C/EBPa-saRNA in male Wistar rats bearing liver cirrhosis/HCC promoted increased circulating levels of albumin, amelioration of liver function, and reduced tumor burden.

The Survival of Cirrhotic Animals after 70% Hepatectomy:

10 rates from each group were operated for verification of the survival rate. After 70% hepatectomy, the cirrhotic animals were monitored for survival rate. 50% of the control animal (5/10) and scrambled-saRNA group (5/10) were dead after $7^{th}$ day, however, the survival rates in animals treated by C/EBPA-saRNA was 100% (10/10). The decrease of surgical mortality in cirrhotic animals was noted after treatment of C/EBPA-saRNA significantly (p=0.03 versus control group or scrambled-saRNA group by Fisher's exact test).

Remnant Liver Regeneration:

Seven days after hepatectomy, the regeneration rate showed a significant increase after C/EBPA-saRNA treatment in-group 1 compared with that of group 2 (p=0.006) and group 3 (p=0.01), whereas there was no significant difference between group 2 and group 3. The increased ratio in group 3 cannot be explained by changes in body weight that showed no significant difference among the three groups before and after hepatectomy (data no shown).

Brd U Labeling Index:

The number of Brd U labeling cells were much higher in C/EBPA-saRNA group 7 days post hepatectomy in contrast to control group (p=0.001) and scrambled-saRNA group (p=0.024). Some areas in the livers obtained from the control group contained no Brd U positively stained cells.

PCNA and Ki67 Assays:

The number of PCNA positively stained cells was much higher in C/EBPA-saRNA group 7 days post hepatectomy. PCNA labeling index was significantly higher in C/EBPA-saRNA group in contrast to control group (p=0.017) but not to scrambled-saRNA group (p=0.06). Ki-67 labeling index was significantly higher in C/EBPA-saRNA group in contrast to control group (p=0.001) and scrambled-saRNA group (p=0.014) both.

Pretreatment liver weight/body weight, post-treatment liver weight/body weight, regeneration rate, and the number of BrdU, PCNA, or Ki-67 labeling index were shown in Table 17.

that they preferentially accumulate in peripheral blood mononuclear cells and the liver with no discernible toxicity. Intravenous injection of C/EPBa-saRNA-dendrimers over a course of 1 week showed a significant improvement of

TABLE 17

| Liver weight/body weight pre and post treatment | | | | |
|---|---|---|---|---|
| | | | pre LW/BW | post LW/BW |
| CEBPA | 1 | a-2 | 4 | 3.5 |
| | 2 | a-3 | 4.5 | 4 |
| | 3 | a-4 | 5 | 4 |
| | 4 | a-5 | 4.67 | 3.5 |
| | 5 | b-2 | 4.5 | 3.6 |
| | 6 | b-3 | 3.8 | 2.9 |
| | 7 | b-4 | 4.2 | 3 |
| | 8 | c-1 | 5.2 | 4.6 |
| | 9 | e-3 | 4.8 | 4 |
| | 10 | e-5 | 4.4 | 3.9 |
| | | MEAN | 4.51 | 3.7 |
| | | SD | 0.43 | 0.51 |
| Control | 1 | c-2 | 4.5 | 3 |
| | 2 | c-4 | 5 | 2.5 |
| | 3 | c-5 | 5.2 | 2.9 |
| | 4 | d-1 | 4.4 | 3 |
| | 5 | d-2 | 4.8 | 4 |
| | | MEAN | 4.78 | 1.16 |
| | | SD | 0.30 | 0.03 |
| Scrambled | 1 | f-1 | 5 | 4 |
| | 2 | f-2 | 4.2 | 3 |
| | 3 | f-3 | 4 | 2.8 |
| | 4 | f-4 | 4.3 | 3 |
| | 5 | f-5 | 4.7 | 2.9 |
| | | MEAN | 4.44 | 3.14 |
| | | SD | 0.40 | 0.49 |

| Regeneration rate, and the number of BrdU, PCNA, or Ki-67 labeling index | | | | | | |
|---|---|---|---|---|---|---|
| | | | Regeneration rate | BrdU | PCNA | Ki-67 |
| CEBPA | 1 | a-2 | | 0.88 | 3 | 7 | 12 |
| | 2 | a-3 | | 0.89 | 2.8 | 6 | 15 |
| | 3 | a-4 | | 0.80 | 2.6 | 4.8 | 9 |
| | 4 | a-5 | | 0.75 | 2.6 | 4.5 | 11 |
| | 5 | b-2 | | 0.80 | 2.4 | 3.6 | 9.5 |
| | 6 | b-3 | | 0.76 | 2 | 3 | 13 |
| | 7 | b-4 | | 0.71 | 2.6 | 4.1 | 13 |
| | 8 | c-1 | | 0.88 | 2.2 | 3.3 | 11 |
| | 9 | e-3 | | 0.83 | 1.9 | 3 | 7.4 |
| | 10 | e-5 | | 0.89 | 2.3 | 3.5 | 7.2 |
| | | MEAN | | 0.82 | 2.44 | 4.28 | 10.81 |
| | | SD | | 0.06 | 0.35 | 1.33 | 2.54 |
| Control | 1 | c-2 | | 0.67 | 1.4 | 2 | 7 |
| | 2 | c-4 | | 0.50 | 1.6 | 2 | 5.5 |
| | 3 | c-5 | | 0.56 | 2 | 3 | 2.4 |
| | 4 | d-1 | | 0.68 | 1.5 | 2.8 | 4 |
| | 5 | d-2 | | 0.83 | 2 | 3 | 8.2 |
| | | MEAN | | 0.65 | 1.7 | 2.56 | 5.42 |
| | | SD | | 0.11 | 0.25 | 0.46 | 2.07 |
| | | | p = | 0.01 | 0.0012 | 0.016888659 | 0.001583619 |
| Scrambled | 1 | f-1 | | 0.80 | 1.8 | 3.3 | 9 |
| | 2 | f-2 | | 0.71 | 2.2 | 2.4 | 8.5 |
| | 3 | f-3 | | 0.70 | 2 | 2.9 | 8 |
| | 4 | f-4 | | 0.70 | 2 | 2.9 | 4.7 |
| | 5 | f-5 | | 0.62 | 2.1 | 3.5 | 5.6 |
| | | MEAN | | 0.71 | 1.02 | 3 | 7.16 |
| | | SD | | 0.07 | 0.15 | 0.42 | 1.90 |
| | | | p = | 0.01 | 0.024017 | 0.060041152 | 0.014500321 |

Discussion

To test the potential therapeutic value of the C/EPBa-saRNA, an in vivo study using a cirrhotic rat model was subsequently performed. For targeted delivery of C/EPBa-saRNA the duplex RNA molecule was linked to cationic PAMAM dendrimers. These nanoparticles have previously been evaluated where biodistribution studies demonstrate survival rate after 70% hepatectomy compared to PBS control or scramble-saRNA-dendrimer control groups.

Furthermore, the improving in liver regeneration was detected by increase in Brd U, PCNA and Ki-67 staining in the liver sections from the C/EBPa-saRNA-treated group. From a clinical perspective, this represents an attractive therapeutic avenue to decrease the surgical mortality of cirrhotic patients and accelerate the recovery form liver resection.

The results suggest that repeated treatments of C/EPBa-saRNA may have a positive impact on the regeneration of fibrotic liver in the rats after liver resection, and it will decrease the surgical mortality in cirrhotic animals.

Hypothesis Around CEBPA Treatment

Figure 37:
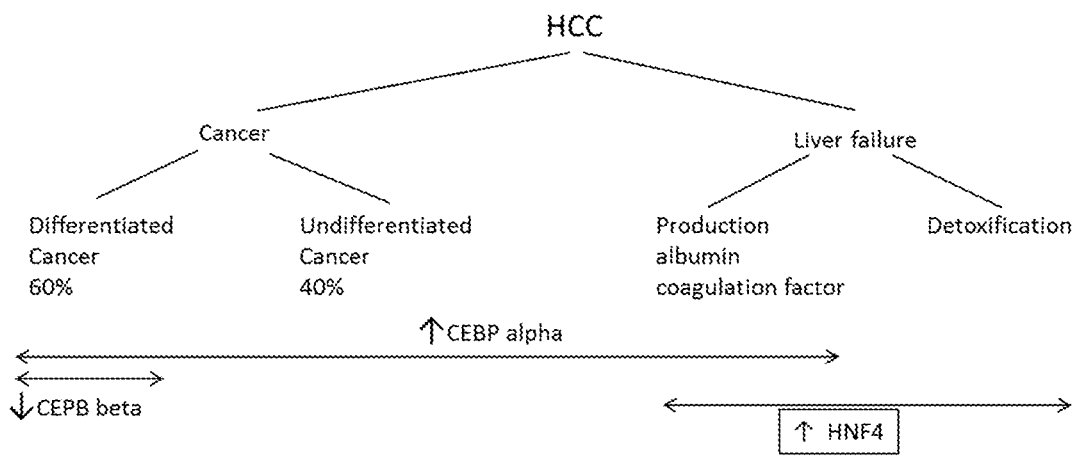
FIG. 37 shows factors involved in HCC and liver failure.

Genes involved in HCC include CEBPA, CEBPB and HNF4. Not willing to be bound to any theory, as illustrated in FIG. 37, CEBPA is involved in not only HCC cancer including differentiated cancer (60%) and undifferentiated cancer (40%) but also liver failure causing failed production of albumin and coagulation factors. FIG. 37 also included a patient stratification for various therapies. Child-Pugh is a scoring system for liver cirrhosis. A is healthy, C is very unhealthy. Differentiation refers to the HCC tumor. % are estimates of proportions of stated differentiation relative to advanced HCC patient population. CEBPA-saRNA may be used in distinct proliferative conditions such as in HCC with low CEBPA expression and in HCC with high CEBPA following abrogation of CEBPB-LIP-20KD. In the meantime, CEBPA-saRNA may be used to assist liver regeneration following major liver resection. It is capable to be clinically useful in stopping proliferation or enhancing proliferation, according to the context. Therefore, CEBPA may be used as supportive care as it improved regeneration rate following removal of 70% of rat livers.

Example 23

Additional saRNA Sequences

Nucleotide walk around bioinformatics hotspots (AW1, AW2, PR2) was conducted. The saRNA sequences were prescreened for cross reactivity and minimized potential off-target effects. Sequences of the saRNAs were shown in Table 18.

TABLE 18

| Duplex ID/Target | Name | Sense-ID | Sense sequence | SEQ ID NO |
|---|---|---|---|---|
| | Sense sequences (lower case means 2'O-Me modification) | | | |
| XD-03287 CEBPA | CEBPA-AW01-500000 | | | |
| XD-03291 scrambel | NC-500000 | | | |
| XD-03300 CEBPA | CEBPA-AW01-420000 | X09312 | GUCACUGGUCAGCUCCAGCUU | 278 |
| XD-03301 CEBPA | CEBPA-AW01-460000 | X09314 | CAUUGUCACUGGUCAGCUCUU | 279 |
| XD-03302 CEBPA | CEBPA-AW01-510000 | X09316 | GCGGUCAUUGUCACUGGUCUU | 280 |
| XD-03303 CEBPA | CEBPA-AW01-520000 | X09318 | GGCGGUCAUUGUCACUGGUUU | 281 |
| XD-03304 CEBPA | CEBPA-AW01-530000 | X09320 | AGGCGGUCAUUGUCACUGGUU | 282 |
| XD-03305 CEBPA | CEBPA-AW01-540000 | X09322 | CAGGCGGUCAUUGUCACUGUU | 283 |
| XD-03306 CEBPA | CEBPA-AW01-550000 | X09324 | GCAGGCGGUCAUUGUCACUUU | 284 |
| XD-03307 CEBPA | CEBPA-AW01-560000 | X09326 | CGCAGGCGGUCAUUGUCACUU | 285 |
| XD-03308 CEBPA | CEBPA-AW01-570000 | X09328 | GCGCAGGCGGUCAUUGUCAUU | 286 |
| XD-03309 CEBPA | CEBPA-AW01-580000 | X09330 | UGCGCAGGCGGUCAUUGUCUU | 287 |
| XD-03310 CEBPA | CEBPA-AW01-590000 | X09332 | UUGCGCAGGCGGUCAUUGUUU | 288 |
| XD-03311 CEBPA | CEBPA-AW02-400000 | X09334 | AUUCAUCCUCCUCGCGGGGUU | 289 |
| XD-03312 CEBPA | CEBPA-AW02-410000 | X09336 | GAUUCAUCCUCCUCGCGGGUU | 290 |
| XD-03313 CEBPA | CEBPA-AW02-420000 | X09338 | GGAUUCAUCCUCCUCGCGGUU | 291 |
| XD-03314 CEBPA | CEBPA-AW02-430000 | X09340 | AGGAUUCAUCCUCCUCGCGUU | 292 |

TABLE 18-continued

| Duplex ID/Target | Name | Antisense-ID | Antisense sequence | SEQ ID NO |
|---|---|---|---|---|
| XD-03315 CEBPA | CEBPA-AW02-440000 | X09342 | AAGGAUUCAUCCUCCUCGCUU | 293 |
| XD-03316 CEBPA | CEBPA-AW02-450000 | X09344 | AAAGGAUUCAUCCUCCUCGUU | 294 |
| XD-03317 CEBPA | CEBPA-AW02-460000 | X09346 | UGAAAGGAUUCAUCCUCCUUU | 295 |
| XD-03318 CEBPA | CEBPA-AW02-480000 | X09348 | CUGAAAGGAUUCAUCCUCCUU | 296 |
| XD-03319 CEBPA | CEBPA-AW02-490000 | X09350 | GCUGAAAGGAUUCAUCCUCUU | 297 |
| XD-03320 CEBPA | CEBPA-AW02-500000 | X09352 | AGCUGAAAGGAUUCAUCCUUU | 298 |
| XD-03321 CEBPA | CEBPA-AW02-510000 | X09354 | CAGCUGAAAGGAUUCAUCCUU | 299 |
| XD-03322 CEBPA | CEBPA-AW02-520000 | X09356 | CCAGCUGAAAGGAUUCAUCUU | 300 |
| XD-03323 CEBPA | CEBPA-AW02-530000 | X09358 | GCCAGCUGAAAGGAUUCAUUU | 301 |
| XD-03324 CEBPA | CEBPA-AW02-540000 | X09360 | CGCCAGCUGAAAGGAUUCAUU | 302 |
| XD-03325 CEBPA | CEBPA-AW02-550000 | X09362 | GCGCCAGCUGAAAGGAUUCUU | 303 |
| XD-03326 CEBPA | CEBPA-AW02-560000 | X09364 | AGCGCCAGCUGAAAGGAUUUU | 304 |
| XD-03327 CEBPA | CEBPA-AW02-570000 | X09366 | CAGCGCCAGCUGAAAGGAUUU | 305 |
| XD-03328 CEBPA | CEBPA-AW02-580000 | X09368 | CCAGCGCCAGCUGAAAGGAUU | 306 |
| XD-03329 CEBPA | CEBPA-AW02-590000 | X09370 | GCCAGCGCCAGCUGAAAGGUU | 307 |
| XD-03330 CEBPA | CEBPA-AW02-600000 | X09372 | GGCCAGCGCCAGCUGAAAGUU | 308 |
| XD-03331 CEBPA | CEBPA-PRO2-400000 | X09374 | CUUCAUCCUCCUCGCGGGGUU | 309 |
| XD-03332 CEBPA | CEBPA-PRO2-420000 | X09376 | GGCUUCAUCCUCCUCGCGGUU | 310 |
| XD-03333 CEBPA | CEBPA-PRO2-500000 | X09378 | AGCUGCUUGGCUUCAUCCUUU | 311 |
| XD-03334 CEBPA | CEBPA-PRO2-540000 | X09380 | CGCCAGCUGCUUGGCUUCAUU | 312 |
| XD-03335 CEBPA | CEBPA-PRO2-560000 | X09382 | AGCGCCAGCUGCUUGGCUUUU | 313 |
| XD-03292 Fluc | Fluc MiNA modified | X09208 | CuUACGcUGAGUACUUCGAsusu | 314 |
| XD-00033 AHA1 | EEL, transfection control | X00122 | GGAuGAAGuGGAGAuuAGudTsdT | 315 |

| Antisense sequences (lower case means 2'O-Me modification) | | | | |
|---|---|---|---|---|
| Duplex ID/Target | Name | Antisense-ID | Antisense sequence | SEQ ID NO |
| XD-03287 CEBPA | CEBPA-AW01-500000 | | positive control | |
| XD-03291 scrambel | NC-500000 | | scrambled control | |

TABLE 18-continued

| | | | | |
|---|---|---|---|---|
| XD-03300 CEBPA | CEBPA-AW01-420000 | X09313 | GCUGGAGCUGACCAGUGACUU | 316 |
| XD-03301 CEBPA | CEBPA-AW01-460000 | X09315 | GAGCUGACCAGUGACAAUGUU | 317 |
| XD-03302 CEBPA | CEBPA-AW01-510000 | X09317 | GACCAGUGACAAUGACCGCUU | 318 |
| XD-03303 CEBPA | CEBPA-AW01-520000 | X09319 | ACCAGUGACAAUGACCGCCUU | 319 |
| XD-03304 CEBPA | CEBPA-AW01-530000 | X09321 | CCAGUGACAAUGACCGCCUUU | 320 |
| XD-03305 CEBPA | CEBPA-AW01-540000 | X09323 | CAGUGACAAUGACCGCCUGUU | 321 |
| XD-03306 CEBPA | CEBPA-AW01-550000 | X09325 | AGUGACAAUGACCGCCUGCUU | 322 |
| XD-03307 CEBPA | CEBPA-AW01-560000 | X09327 | GUGACAAUGACCGCCUGCGUU | 323 |
| XD-03308 CEBPA | CEBPA-AW01-570000 | X09329 | UGACAAUGACCGCCUGCGCUU | 324 |
| XD-03309 CEBPA | CEBPA-AW01-580000 | X09331 | GACAAUGACCGCCUGCGCAUU | 325 |
| XD-03310 CEBPA | CEBPA-AW01-590000 | X09333 | ACAAUGACCGCCUGCGCAAUU | 326 |
| XD-03311 CEBPA | CEBPA-AW02-400000 | X09335 | CCCCGCGAGGAGGAUGAAUUU | 327 |
| XD-03312 CEBPA | CEBPA-AW02-410000 | X09337 | CCCGCGAGGAGGAUGAAUCUU | 328 |
| XD-03313 CEBPA | CEBPA-AW02-420000 | X09339 | CCGCGAGGAGGAUGAAUCCUU | 329 |
| XD-03314 CEBPA | CEBPA-AW02-430000 | X09341 | CGCGAGGAGGAUGAAUCCUUU | 330 |
| XD-03315 CEBPA | CEBPA-AW02-440000 | X09343 | GCGAGGAGGAUGAAUCCUUUU | 331 |
| XD-03316 CEBPA | CEBPA-AW02-450000 | X09345 | CGAGGAGGAUGAAUCCUUUUU | 332 |
| XD-03317 CEBPA | CEBPA-AW02-460000 | X09347 | AGGAGGAUGAAUCCUUUCAUU | 333 |
| XD-03318 CEBPA | CEBPA-AW02-480000 | X09349 | GGAGGAUGAAUCCUUUCAGUU | 334 |
| XD-03319 CEBPA | CEBPA-AW02-490000 | X09351 | GAGGAUGAAUCCUUUCAGCUU | 335 |
| XD-03320 CEBPA | CEBPA-AW02-500000 | X09353 | AGGAUGAAUCCUUUCAGCUUU | 336 |
| XD-03321 CEBPA | CEBPA-AW02-510000 | X09355 | GGAUGAAUCCUUUCAGCUGUU | 337 |
| XD-03322 CEBPA | CEBPA-AW02-520000 | X09357 | GAUGAAUCCUUUCAGCUGGUU | 338 |
| XD-03323 CEBPA | CEBPA-AW02-530000 | X09359 | AUGAAUCCUUUCAGCUGGCUU | 339 |
| XD-03324 CEBPA | CEBPA-AW02-540000 | X09361 | UGAAUCCUUUCAGCUGGCGUU | 340 |
| XD-03325 CEBPA | CEBPA-AW02-550000 | X09363 | GAAUCCUUUCAGCUGGCGCUU | 341 |
| XD-03326 CEBPA | CEBPA-AW02-560000 | X09365 | AAUCCUUUCAGCUGGCGCUUU | 342 |

TABLE 18-continued

| | | | | |
|---|---|---|---|---|
| XD-03327 CEBPA | CEBPA-AW02-570000 | X09367 | AUCCUUUCAGCUGGCGCUGUU | 343 |
| XD-03328 CEBPA | CEBPA-AW02-580000 | X09369 | UCCUUUCAGCUGGCGCUGGUU | 344 |
| XD-03329 CEBPA | CEBPA-AW02-590000 | X09371 | CCUUUCAGCUGGCGCUGGCUU | 345 |
| XD-03330 CEBPA | CEBPA-AW02-600000 | X09373 | CUUUCAGCUGGCGCUGGCCUU | 346 |
| XD-03331 CEBPA | CEBPA-PR02-400000 | X09375 | CCCCGCGAGGAGGAUGAAGUU | 347 |
| XD-03332 CEBPA | CEBPA-PR02-420000 | X09377 | CCGCGAGGAGGAUGAAGCCUU | 348 |
| XD-03333 CEBPA | CEBPA-PR02-500000 | X09379 | AGGAUGAAGCCAAGCAGCUUU | 349 |
| XD-03334 CEBPA | CEBPA-PR02-540000 | X09381 | UGAAGCCAAGCAGCUGGCGUU | 350 |
| XD-03335 CEBPA | CEBPA-PR02-560000 | X09383 | AAGCCAAGCAGCUGGCGCUUU | 351 |
| XD-03292 Fluc | Fluc MiNA modified | X09209 | UcGAAGuAcUCAGcGUAAgsusu | 352 |
| XD-00033 AHA1 | EEL, transfection control | X00123 | ACuAAUCUCcACUUcAUCCdTsdT | 353 |

Figure 38A:
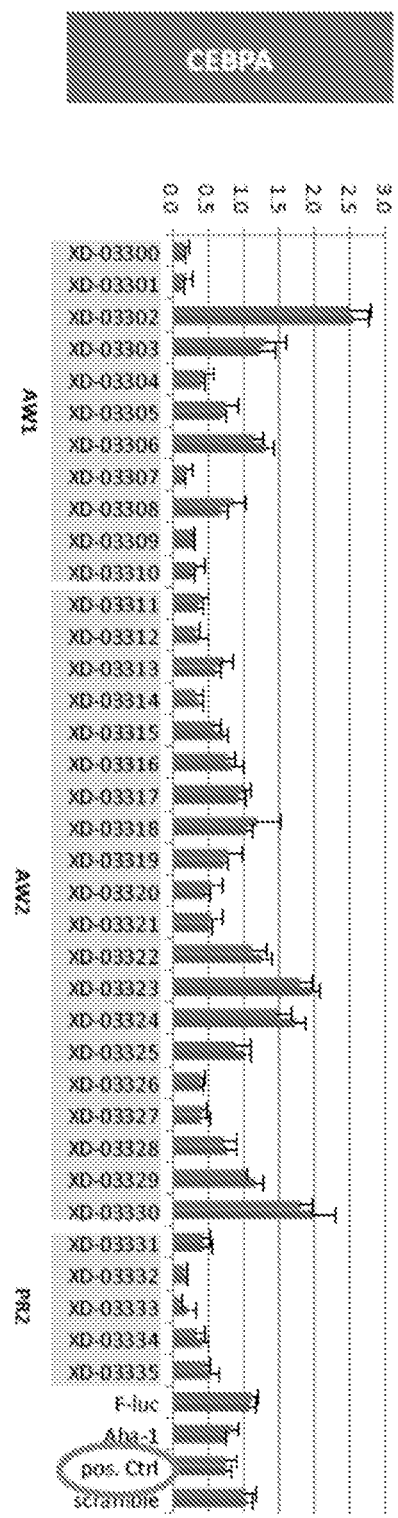
FIG. 38A-38E: Expression study.
Figure 38B:
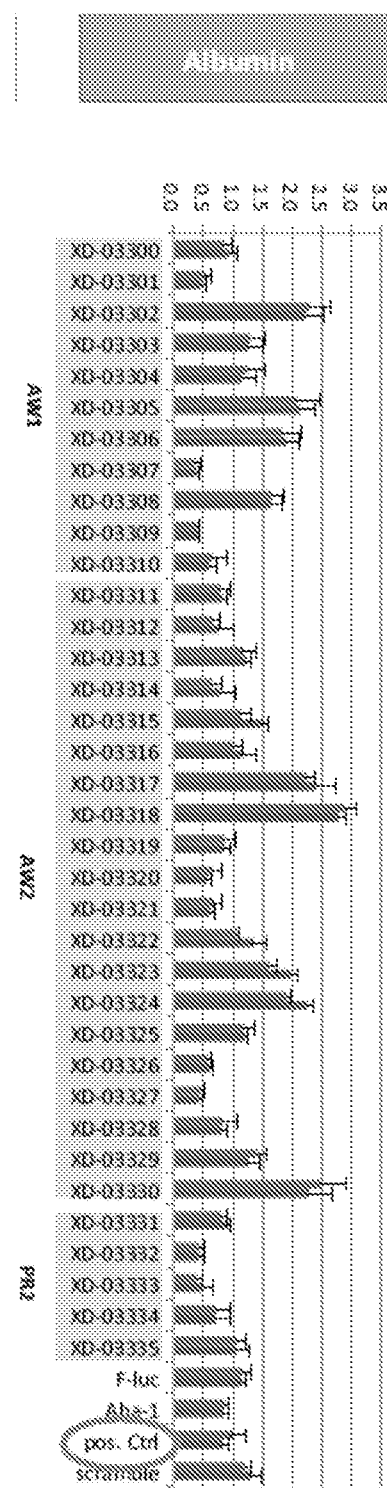
Figure 38C:
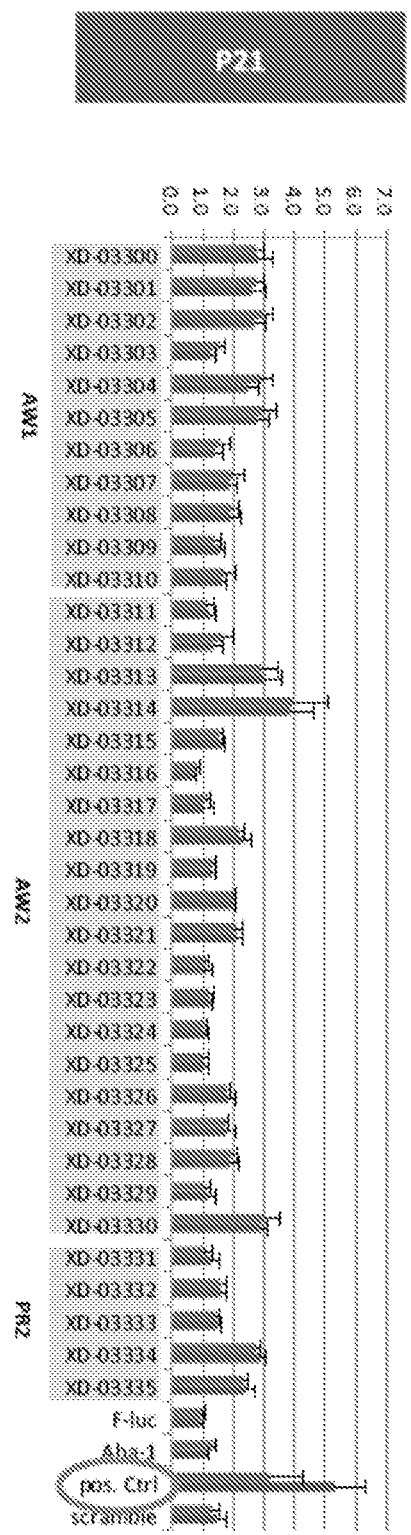
Figure 38D:
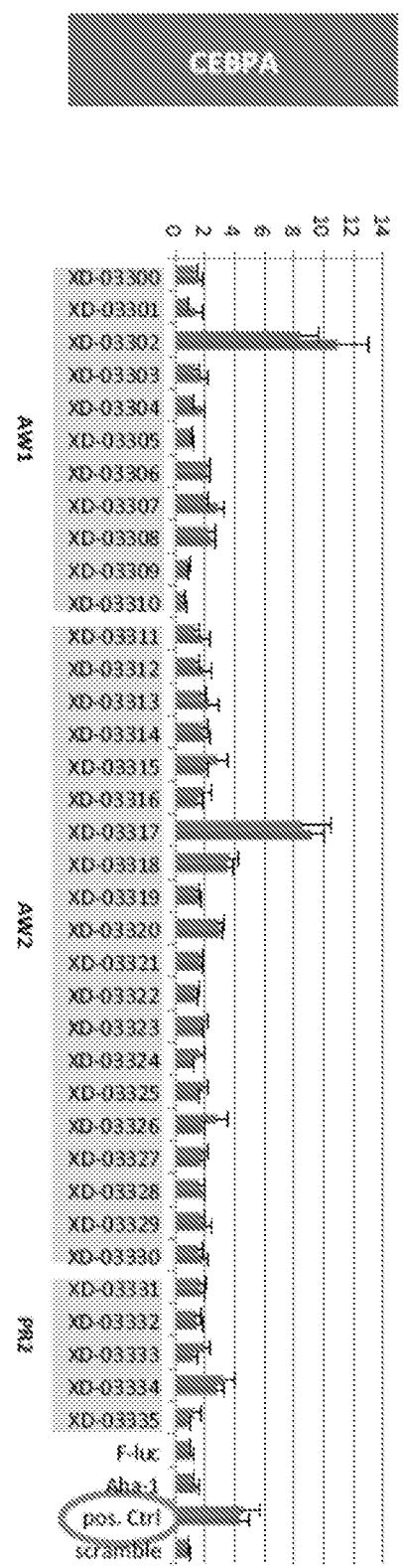
Figure 38E:
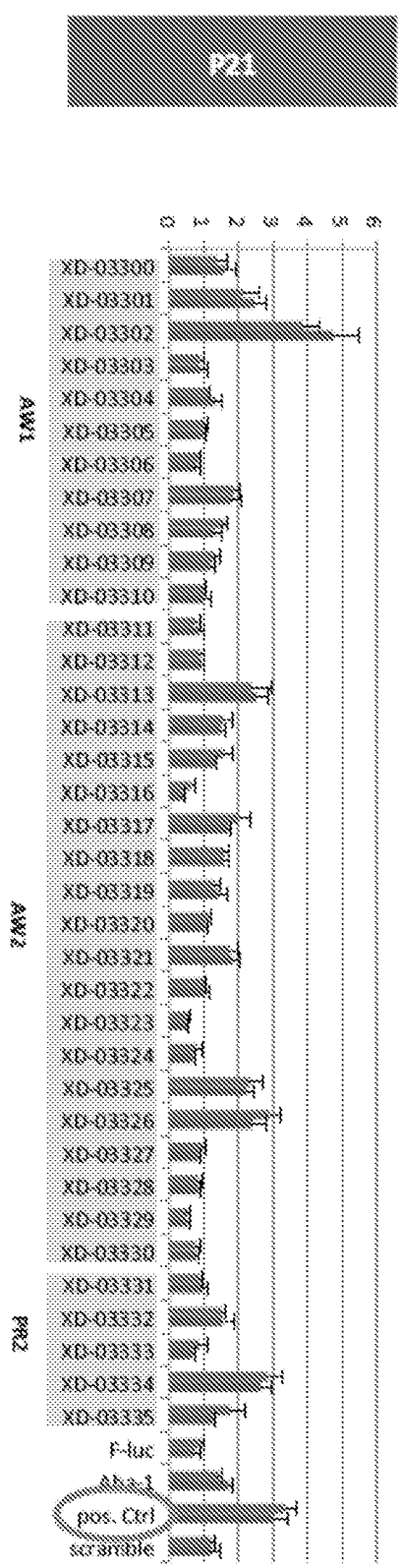

The saRNAs were screened with a bDNA assay system in quadruplicate in HepG2 cells, wherein CEPBPA mRNA (target), albumin mRNA (downstream), and p21 mRNA (downstream) levels were measured. The results were shown in FIG. 38A-38C. They were also screened in DU145 cells, wherein CEBPA mRNA (target) and p21 mRNA (downstream) levels were measured. All cells were reverse transfected at 0 hr and forward transfected at 24 hr followed by harvest at 72 hr. The results were shown in FIG. 65D-65E. Two concentrations of the saRNAs were used: 8 nM and 50 nM.

Dose response studies of some saRNAs were conducted with bDNA assay system in quadruplicate in HepG2 and DU145 cells. CEBPA mRNA (FIG. 39A), albumin mRNA (FIG. 39B), and p21 mRNA (FIG. 39C) levels in HepG2 cells were measured. Results were normalized to GAPDH and GAPDH mRNA levels in HepG2 cells were shown in FIG. 39D. CEBPA mRNA (FIG. 39E) and p21 mRNA (FIG. 39F) levels in DU145 cells were measured. Results were normalized to GAPDH and GAPDH mRNA levels in DU145 cells were shown in FIG. 39G. All cells were reverse transfected at 0 hr and forward transfected at 24 hr followed by harvest at 72 hr. Four concentrations of the saRNA were used: 1.25 nM, 2.5 nM, 5 nM and 10 nM.

Figure 40:
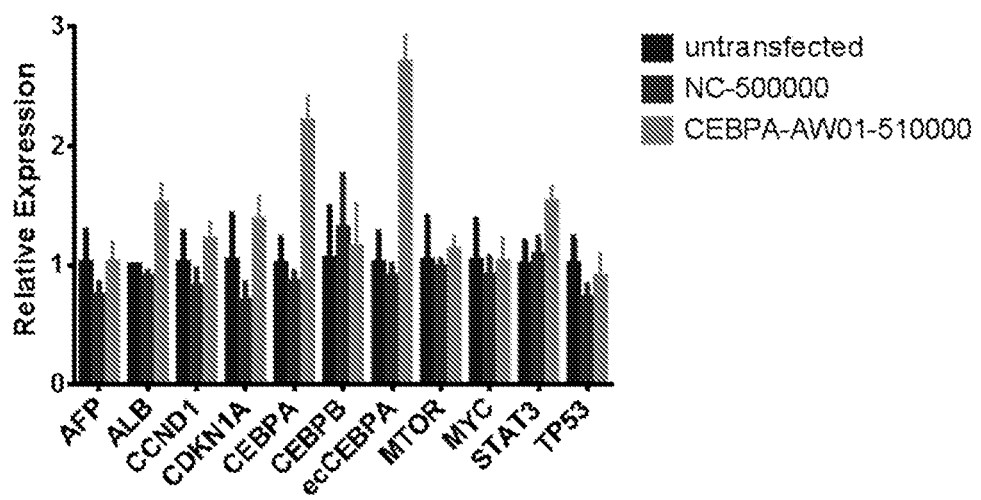
FIG. 40 shows ALB, CCND1, CDKN1A, CEBPA, CEBPB, ecCEBPA, MTOR, MYC, STAT3 AND TP53 relative expressions in HepG2 cells transfected with CEBPA-saRNA.

HepG2 cells were reverse transfected with 50 nM CEBPA-AW01-510000 (XD-03302) at seeding, forward transfected 24 hours later, and harvested at 72 hours. Activation of ALB, CEBPA, ecCEBPA, and STAT3 were observed as shown in FIG. 40.

The saRNA sequences in Table 18 were modified, for example but not limited to, with 2'O-Me modifications, inverted abasic modifications as shown in Table 19. HepG2 and DU145 cells were transfected with the chemically modified saRNA sequences at various concentrations (5 nM and 10 nM) and CEBPA mRNA, p21 mRNA, albumin mRNA, and AFP mRNA levels were measured with bDNA assays. Results were shown in the tables (Tables 20-26) below. Expression in mock-treated cells=1.

TABLE 19

CEBPA saRNA modifications - sense sequences (lower case means 2'O-Me modification)

| Target | Duplex ID | Sense ID | Sense sequence | SEQ ID No. | Notes |
|---|---|---|---|---|---|
| CEBPA | XD-03287 | | | | Positive control |
| CEBPA | XD-03302 | X09316 | GCGGUCAUUGUCACUGGUCUU | 280 | |
| CEBPA | XD-03317 | X09346 | UGAAAGGAUUCAUCCUCCUUU | 295 | |
| CEBPA | XD-03318 | X09348 | CUGAAAGGAUUCAUCCUCCUU | 296 | |

TABLE 19-continued

| Target | Duplex ID | | Sequence | SEQ ID No. | Notes |
|---|---|---|---|---|---|
| CEBPA | XD-03330 | X09372 | GGCCAGCGCCAGCUGAAA GUU | 308 | |
| Fluc | XD-03292 | X09208 | CuUACGcUGAGUACUUCGA susu | 314 | Fluc MiNA modified |
| AHA1 | XD-00033 | X00122 | GGAuGAAGuGGAGAuuAGud TsdT | 315 | EEL, transfection control |
| CEBPA | XD-03923 | X11262 | (invabasic)CGGUCAUUGUCA CUGGUCAUU | 258 | XD-03287_IA |
| CEBPA | XD-03924 | X11263 | (invabasic)GCGGUCAUUGUC ACUGGUCUU | 354 | XD-03302_IA |
| CEBPA | XD-03925 | X11264 | (invabasic)UGAAAGGAUUCA UCCUCCUUU | 355 | XD-03317_IA |
| CEBPA | XD-03926 | X11265 | (invabasic)CUGAAAGGAUUC AUCCUCCUU | 356 | XD-03318_IA |
| CEBPA | XD-03927 | X11266 | (invabasic)GGCCAGCGCCAG CUGAAAGUU | 357 | XD-03330_IA |
| CEBPA | XD-03928 | X11267 | (invabasic)CgGuCaUuGuCaCu GgUCauu | 358 | XD-03287_IA_MiNA |
| CEBPA | XD-03929 | X11268 | (invabasic)GCgGuCaUuGuCaC uGgUCuu | 359 | XD-03302_IA_MiNA |
| CEBPA | XD-03930 | X11269 | (invabasic)UgAaAgGaUuCAuC CuCCuuu | 360 | XD-03317_IA_MiNA |
| CEBPA | XD-03931 | X11270 | (invabasic)CuGaAaGgAuUcAu CCuCCuu | 361 | XD-03318_IA_MiNA |
| CEBPA | XD-03932 | X11271 | (invabasic)GgCCAgCgCCAgCu GaAaGuu | 362 | XD-03330_IA_MiNA |
| CEBPA | XD-03933 | X11272 | (invabasic)cgGuCAUUGuCACu GGUCAuu | 363 | XD-03287_IA_AXO1 |
| CEBPA | XD-03934 | X11273 | (invabasic)gcGgUCAUUgUCAc UGGUCuu | 364 | XD-03302_IA_AXO1 |
| CEBPA | XD-03935 | X11274 | (invabasic)ugAaAGGAUuCAUc CUCCUuu | 365 | XD-03317_IA_AXO1 |
| CEBPA | XD-03936 | X11275 | (invabasic)cuGaAAGGAuUCAu CCUCCuu | 366 | XD-03318_IA_AXO1 |
| CEBPA | XD-03937 | X11276 | (invabasic)ggCcAGCGCcAGCu GAAAGuu | 367 | XD-03330_IA_AXO1 |
| CEBPA | XD-03938 | X11277 | (invabasic)cgGucAuuGucAcuG GucAuu | 368 | XD-03287_IA_AXO2 |
| CEBPA | XD-03939 | X11278 | (invabasic)gcGGucAuuGucAcu GGucuu | 369 | XD-03302_IA_AXO2 |
| CEBPA | XD-03940 | X11279 | (invabasic)ugAAAGGAuucAuc cuccuuu | 370 | XD-03317_IA_AXO2 |
| CEBPA | XD-03941 | X11280 | (invabasic)cuGAAAGGAuucAu ccuccuu | 371 | XD-03318_IA_AXO2 |
| CEBPA | XD-03942 | X11281 | (invabasic)ggccAGcGccAGcuG AAAGuu | 372 | XD-03330_IA_AXO2 |

CEBPA saRNA modifications - antisense sequences (lower case means 2'O-Me modification)

| Target | Duplex ID | Antisense ID | Antisense sequence | SEQ ID No. | Notes |
|---|---|---|---|---|---|
| CEBPA | XD-03287 | | | | Positive control |
| CEBPA | XD-03302 | X09317 | GACCAGUGACAAUGACCG CUU | 318 | |

TABLE 19-continued

| | | | | | |
|---|---|---|---|---|---|
| CEBPA | XD-03317 | X09347 | AGGAGGAUGAAUCCUUUC AUU | 333 | |
| CEBPA | XD-03318 | X09349 | GGAGGAUGAAUCCUUUCA GUU | 334 | |
| CEBPA | XD-03330 | X09373 | CUUUCAGCUGGCGCUGGC CUU | 346 | |
| Fluc | XD-03292 | X09209 | UcGAAGuAcUCAGcGUAAgs usu | 352 | Fluc MiNA modified |
| AHA1 | XD-00033 | X00123 | ACuAAUCUCcACUUcAUCC dTsdT | 353 | EEL, transfection control |
| CEBPA | XD-03923 | X09199 | UGACCAGUGACAAUGACC GUU | 257 | XD-03287_IA |
| CEBPA | XD-03924 | X09317 | GACCAGUGACAAUGACCG CUU | 318 | XD-03302_IA |
| CEBPA | XD-03925 | X09347 | AGGAGGAUGAAUCCUUUC AUU | 333 | XD-03317_IA |
| CEBPA | XD-03926 | X09349 | GGAGGAUGAAUCCUUUCA GUU | 334 | XD-03318_IA |
| CEBPA | XD-03927 | X09373 | CUUUCAGCUGGCGCUGGC CUU | 346 | XD-03330_IA |
| CEBPA | XD-03928 | X11282 | UGACCAGUGACAAUGACC Guu | 373 | XD-03287_IA_MiNA |
| CEBPA | XD-03929 | X11283 | GACCAGUGACAAUGACCG Cuu | 374 | XD-03302_IA_MiNA |
| CEBPA | XD-03930 | X11284 | AGGAGGAUGAAUCCUUUC Auu | 375 | XD-03317_IA_MiNA |
| CEBPA | XD-03931 | X11285 | GGAGGAUGAAUCCUUUCA Guu | 376 | XD-03318_IA_MiNA |
| CEBPA | XD-03932 | X11286 | CUUUCAGCUGGCGCUGGC Cuu | 377 | XD-03330_IA_MINA |
| CEBPA | XD-03933 | X11282 | UGACCAGUGACAAUGACC Guu | 373 | XD-03287_IA_AXO1 |
| CEBPA | XD-03934 | X11283 | GACCAGUGACAAUGACCG Cuu | 374 | XD-03302_IA_AXO1 |
| CEBPA | XD-03935 | X11284 | AGGAGGAUGAAUCCUUUC Auu | 375 | XD-03317_IA_AXO1 |
| CEBPA | XD-03936 | X11285 | GGAGGAUGAAUCCUUUCA Guu | 376 | XD-03318_IA_AXO1 |
| CEBPA | XD-03937 | X11286 | CUUUCAGCUGGCGCUGGC Cuu | 377 | XD-03330_IA_AXO1 |
| CEBPA | XD-03938 | X11287 | UGACcAGUGAcAAUGACC Guu | 378 | XD-03287_IA_AXO2 |
| CEBPA | XD-03939 | X11288 | GACcAGUGAcAAUGACCG Cuu | 379 | XD-03302_IA_AXO2 |
| CEBPA | XD-03940 | X11289 | AGGAGGAUGAAUCCUUUc Auu | 380 | XD-03317_IA_AXO2 |
| CEBPA | XD-03941 | X11290 | GGAGGAUGAAUCCUUUcA Guu | 381 | XD-03318_IA_AXO2 |
| CEBPA | XD-03942 | X11291 | CUUUcAGCUGGCGCUGGC Cuu | 382 | XD-03330_IA_AXO2 |

TABLE 20

CEBPA mRNA levels in HepG2 cells

| Name | Relative mRNA CEBPA 5 nM | SD | Relative mRNA CEBPA 10 nM | SD |
|---|---|---|---|---|
| XD-03287 | 1.00 | 0.08 | 0.71 | 0.09 |
| XD-03923 | 0.99 | 0.11 | 0.73 | 0.04 |
| XD-03928 | 0.94 | 0.04 | 0.59 | 0.10 |
| XD-03933 | 1.03 | 0.05 | 0.58 | 0.15 |
| XD-03938 | 0.94 | 0.08 | 0.83 | 0.34 |
| XD-03302 | 1.68 | 0.13 | 1.50 | 0.20 |
| XD-03924 | 1.75 | 0.10 | 1.37 | 0.10 |
| XD-03929 | 1.57 | 0.31 | 1.27 | 0.15 |
| XD-03934 | 1.91 | 0.72 | 1.31 | 0.12 |
| XD-03939 | 1.04 | 0.21 | 0.76 | 0.02 |
| XD-03317 | 1.12 | 0.02 | 0.84 | 0.04 |
| XD-03925 | 1.10 | 0.04 | 0.83 | 0.04 |
| XD-03930 | 1.10 | 0.14 | 0.80 | 0.08 |
| XD-03935 | 1.13 | 0.08 | 0.83 | 0.10 |
| XD-03940 | 1.17 | 0.05 | 0.69 | 0.04 |
| XD-03318 | 1.45 | 0.26 | 0.86 | 0.05 |
| XD-03926 | 1.05 | 0.06 | 0.69 | 0.15 |
| XD-03931 | 0.70 | 0.07 | 0.45 | 0.04 |
| XD-03936 | 0.80 | 0.17 | 0.46 | 0.05 |
| XD-03941 | 0.69 | 0.06 | 0.42 | 0.03 |
| XD-03330 | 1.44 | 0.07 | 1.40 | 0.06 |
| XD-03927 | 1.48 | 0.19 | 1.44 | 0.05 |
| XD-03932 | 1.21 | 0.22 | 1.31 | 0.09 |
| XD-03937 | 1.43 | 0.05 | 1.31 | 0.07 |
| XD-03942 | 1.18 | 0.10 | 1.09 | 0.06 |
| F-luc | 1.07 | 0.25 | 0.92 | 0.10 |
| Aha-1 | 0.71 | 0.10 | 0.53 | 0.03 |

TABLE 21 p21 mRNA levels in HepG2 cells

| Name | Res. mRNA p21 5 nM | SD | Res. mRNA p21 10 nM | SD |
|---|---|---|---|---|
| XD-03287 | 2.24 | 0.12 | 3.06 | 0.26 |
| XD-03923 | 2.32 | 0.40 | 3.41 | 0.35 |
| XD-03928 | 2.93 | 0.37 | 3.83 | 0.70 |
| XD-03933 | 2.83 | 0.34 | 3.80 | 1.01 |
| XD-03938 | 1.35 | 0.20 | 1.57 | 0.32 |
| XD-03302 | 1.57 | 0.19 | 2.25 | 0.22 |
| XD-03924 | 1.66 | 0.23 | 2.12 | 0.30 |
| XD-03929 | 1.21 | 0.14 | 1.57 | 0.25 |
| XD-03934 | 1.29 | 0.22 | 1.66 | 0.26 |
| XD-03939 | 0.82 | 0.16 | 1.29 | 0.36 |
| XD-03317 | 0.88 | 0.07 | 0.93 | 0.10 |
| XD-03925 | 0.66 | 0.05 | 0.68 | 0.07 |
| XD-03930 | 0.66 | 0.06 | 0.70 | 0.05 |
| XD-03935 | 0.70 | 0.07 | 0.70 | 0.08 |
| XD-03940 | 0.68 | 0.06 | 0.68 | 0.08 |
| XD-03318 | 1.19 | 0.18 | 1.70 | 0.27 |
| XD-03926 | 1.02 | 0.13 | 1.21 | 0.24 |
| XD-03931 | 1.30 | 0.15 | 1.71 | 0.14 |
| XD-03936 | 1.44 | 0.10 | 1.71 | 0.17 |
| XD-03941 | 1.29 | 0.14 | 1.70 | 0.14 |
| XD-03330 | 2.08 | 0.30 | 1.96 | 0.18 |
| XD-03927 | 2.38 | 0.45 | 2.34 | 0.40 |
| XD-03932 | 1.92 | 0.46 | 2.17 | 0.29 |
| XD-03937 | 2.23 | 0.42 | 2.44 | 0.43 |
| XD-03942 | 1.62 | 0.12 | 1.77 | 0.27 |
| F-luc | 1.07 | 0.38 | 1.12 | 0.73 |
| Aha-1 | 0.83 | 0.05 | 0.98 | 0.05 |

TABLE 22

Albumin mRNA levels in HepG2 cells

| Name | Res. mRNA Albumin 5 nM | SD | Res. mRNA Albumin 10 nM | SD |
|---|---|---|---|---|
| XD-03287 | 0.84 | 0.12 | 0.88 | 0.14 |
| XD-03923 | 0.95 | 0.23 | 0.99 | 0.20 |
| XD-03928 | 0.98 | 0.09 | 0.98 | 0.10 |
| XD-03933 | 0.99 | 0.06 | 0.96 | 0.06 |
| XD-03938 | 1.40 | 0.38 | 0.91 | 0.23 |
| XD-03302 | 1.92 | 0.12 | 2.50 | 0.07 |
| XD-03924 | 1.99 | 0.20 | 2.42 | 0.14 |
| XD-03929 | 1.70 | 0.61 | 1.68 | 0.15 |
| XD-03934 | 2.34 | 0.95 | 2.25 | 0.36 |
| XD-03939 | 1.96 | 0.77 | 1.82 | 0.18 |
| XD-03317 | 2.53 | 0.95 | 2.18 | 0.19 |
| XD-03925 | 1.54 | 0.70 | 1.82 | 0.49 |
| XD-03930 | 1.28 | 0.55 | 1.47 | 0.33 |
| XD-03935 | 1.63 | 0.27 | 1.71 | 0.17 |
| XD-03940 | 1.73 | 0.56 | 1.50 | 0.29 |
| XD-03318 | 2.33 | 0.42 | 2.79 | 0.36 |
| XD-03926 | 2.25 | 1.29 | 1.27 | 0.23 |
| XD-03931 | 1.49 | 0.44 | 1.42 | 0.25 |
| XD-03936 | 1.84 | 0.56 | 1.53 | 0.31 |
| XD-03941 | 4.69 | 2.02 | 1.81 | 0.24 |
| XD-03330 | 1.44 | 0.07 | 1.77 | 0.20 |
| XD-03927 | 1.48 | 0.19 | 1.77 | 0.12 |
| XD-03932 | 1.21 | 0.22 | 1.61 | 0.05 |
| XD-03937 | 1.43 | 0.05 | 1.67 | 0.17 |
| XD-03942 | 1.18 | 0.10 | 1.27 | 0.42 |
| F-luc | 1.07 | 0.25 | 0.83 | 0.30 |
| Aha-1 | 1.37 | 0.51 | 1.35 | 0.10 |

TABLE 23

AFP mRNA levels in HepG2 cells

| Name | Res. mRNA AFP 5 nM | SD | Res. mRNA AFP 10 nM | SD |
|---|---|---|---|---|
| XD-03287 | 0.85 | 0.18 | 0.94 | 0.10 |
| XD-03923 | 0.80 | 0.02 | 0.89 | 0.17 |
| XD-03928 | 0.89 | 0.11 | 0.78 | 0.12 |
| XD-03933 | 0.84 | 0.13 | 0.72 | 0.10 |
| XD-03938 | 0.80 | 0.07 | 0.83 | 0.33 |
| XD-03302 | 1.45 | 0.14 | 1.74 | 0.07 |
| XD-03924 | 1.45 | 0.08 | 1.75 | 0.17 |
| XD-03929 | 1.12 | 0.09 | 1.22 | 0.16 |
| XD-03934 | 1.30 | 0.06 | 1.58 | 0.24 |
| XD-03939 | 1.13 | 0.22 | 1.69 | 0.46 |
| XD-03317 | 1.40 | 0.28 | 1.49 | 0.38 |
| XD-03925 | 1.16 | 0.50 | 1.12 | 0.37 |
| XD-03930 | 1.00 | 0.35 | 1.06 | 0.26 |
| XD-03935 | 1.18 | 0.37 | 1.07 | 0.16 |
| XD-03940 | 1.06 | 0.33 | 0.97 | 0.11 |
| XD-03318 | 2.05 | 0.34 | 2.63 | 0.31 |
| XD-03926 | 1.19 | 0.24 | 1.11 | 0.22 |
| XD-03931 | 1.24 | 0.36 | 1.11 | 0.12 |
| XD-03936 | 1.07 | 0.18 | 1.06 | 0.22 |
| XD-03941 | 1.28 | 0.20 | 1.28 | 0.13 |
| XD-03330 | 1.16 | 0.09 | 1.06 | 0.11 |
| XD-03927 | 1.18 | 0.17 | 1.12 | 0.15 |
| XD-03932 | 1.05 | 0.12 | 1.05 | 0.07 |
| XD-03937 | 1.13 | 0.09 | 1.14 | 0.07 |
| XD-03942 | 0.92 | 0.09 | 0.81 | 0.05 |
| F-luc | 0.96 | 0.03 | 0.91 | 0.36 |
| Aha-1 | 0.90 | 0.29 | 1.04 | 0.08 |

TABLE 24

GAPDH mRNA levels in HepG2 cells

| Name | gapdh 5 nM | SD | gapdh 10 nM | SD |
|---|---|---|---|---|
| XD-03287 | 0.55 | 0.07 | 0.47 | 0.07 |
| XD-03923 | 0.69 | 0.15 | 0.45 | 0.09 |
| XD-03928 | 0.56 | 0.06 | 0.48 | 0.12 |
| XD-03933 | 0.60 | 0.10 | 0.50 | 0.24 |
| XD-03938 | 1.02 | 0.11 | 0.86 | 0.22 |
| XD-03302 | 0.67 | 0.07 | 0.40 | 0.08 |
| XD-03924 | 0.62 | 0.08 | 0.43 | 0.07 |
| XD-03929 | 1.05 | 0.10 | 0.67 | 0.15 |
| XD-03934 | 0.85 | 0.13 | 0.56 | 0.09 |
| XD-03939 | 1.36 | 0.29 | 0.83 | 0.14 |
| XD-03317 | 0.61 | 0.04 | 0.42 | 0.05 |
| XD-03925 | 0.57 | 0.05 | 0.42 | 0.07 |
| XD-03930 | 0.68 | 0.12 | 0.41 | 0.07 |
| XD-03935 | 0.59 | 0.06 | 0.39 | 0.05 |
| XD-03940 | 0.63 | 0.04 | 0.42 | 0.05 |
| XD-03318 | 0.74 | 0.06 | 0.49 | 0.04 |
| XD-03926 | 1.05 | 0.11 | 0.89 | 0.13 |
| XD-03931 | 0.88 | 0.04 | 0.66 | 0.02 |
| XD-03936 | 0.98 | 0.10 | 0.62 | 0.04 |
| XD-03941 | 0.96 | 0.06 | 0.66 | 0.06 |
| XD-03330 | 0.49 | 0.06 | 0.36 | 0.04 |
| XD-03927 | 0.45 | 0.06 | 0.35 | 0.03 |
| XD-03932 | 0.63 | 0.16 | 0.40 | 0.05 |
| XD-03937 | 0.51 | 0.13 | 0.30 | 0.03 |
| XD-03942 | 1.00 | 0.55 | 0.82 | 0.50 |
| F-luc | 0.88 | 0.20 | 0.86 | 0.27 |
| Aha-1 | 1.33 | 0.15 | 0.85 | 0.06 |

TABLE 25

CEBPA mRNA levels in DU145 cells

| Name | Res. mRNA CEBPA 5 nM | SD | Res. mRNA CEBPA 10 nM | SD |
|---|---|---|---|---|
| XD-03287 | 5.40 | 1.38 | 4.93 | 0.47 |
| XD-03923 | 5.40 | 0.96 | 5.52 | 0.62 |
| XD-03928 | 6.39 | 1.64 | 7.66 | 1.53 |
| XD-03933 | 6.61 | 2.53 | 6.56 | 1.20 |
| XD-03938 | 2.23 | 0.56 | 2.23 | 0.25 |
| XD-03302 | 6.23 | 2.11 | 6.59 | 0.55 |
| XD-03924 | 8.46 | 1.85 | 10.74 | 0.79 |
| XD-03929 | 2.29 | 0.57 | 2.42 | 0.08 |
| XD-03934 | 2.44 | 0.57 | 3.92 | 0.21 |
| XD-03939 | 0.91 | 0.07 | 1.26 | 0.14 |
| XD-03317 | 5.15 | 0.77 | 6.86 | 1.30 |
| XD-03925 | 2.75 | 0.23 | 3.96 | 0.56 |
| XD-03930 | 2.23 | 0.31 | 3.32 | 0.49 |
| XD-03935 | 2.34 | 0.30 | 3.92 | 0.58 |
| XD-03940 | 2.39 | 0.53 | 4.72 | 2.83 |
| XD-03318 | 2.26 | 0.67 | 4.12 | 0.90 |
| XD-03926 | 0.81 | 0.14 | 1.14 | 0.11 |
| XD-03931 | 1.29 | 0.17 | 2.05 | 0.14 |
| XD-03936 | 1.27 | 0.14 | 2.08 | 0.17 |
| XD-03941 | 1.19 | 0.21 | 1.98 | 0.28 |
| XD-03330 | 1.32 | 0.21 | 1.75 | 0.22 |
| XD-03927 | 1.40 | 0.38 | 1.78 | 0.30 |
| XD-03932 | 1.37 | 0.26 | 1.60 | 0.34 |
| XD-03937 | 1.22 | 0.26 | 1.50 | 0.19 |
| XD-03942 | 1.44 | 0.28 | 1.12 | 0.05 |
| F-luc | 1.18 | 0.06 | 1.13 | 0.19 |
| Aha-1 | 1.30 | 0.33 | 1.82 | 0.14 |

TABLE 26

GAPDH mRNA levels in DU145 cells

| Name | gapdh 5 nM | SD | gapdh 10 nM | SD |
|---|---|---|---|---|
| XD-03287 | 0.15 | 0.04 | 0.13 | 0.03 |
| XD-03923 | 0.16 | 0.03 | 0.12 | 0.03 |
| XD-03928 | 0.15 | 0.04 | 0.10 | 0.04 |
| XD-03933 | 0.16 | 0.05 | 0.12 | 0.04 |
| XD-03938 | 0.60 | 0.11 | 0.49 | 0.07 |
| XD-03302 | 0.26 | 0.06 | 0.17 | 0.04 |
| XD-03924 | 0.20 | 0.04 | 0.15 | 0.03 |
| XD-03929 | 0.68 | 0.13 | 0.56 | 0.06 |
| XD-03934 | 0.58 | 0.10 | 0.39 | 0.05 |
| XD-03939 | 1.34 | 0.10 | 1.03 | 0.06 |
| XD-03317 | 0.20 | 0.04 | 0.17 | 0.05 |
| XD-03925 | 0.23 | 0.02 | 0.19 | 0.07 |
| XD-03930 | 0.36 | 0.07 | 0.26 | 0.05 |
| XD-03935 | 0.32 | 0.09 | 0.21 | 0.06 |
| XD-03940 | 0.38 | 0.10 | 0.24 | 0.04 |
| XD-03318 | 0.32 | 0.10 | 0.17 | 0.05 |
| XD-03926 | 1.17 | 0.13 | 0.87 | 0.04 |
| XD-03931 | 0.76 | 0.08 | 0.51 | 0.02 |
| XD-03936 | 0.84 | 0.06 | 0.55 | 0.05 |
| XD-03941 | 0.92 | 0.14 | 0.63 | 0.02 |
| XD-03330 | 0.70 | 0.21 | 0.55 | 0.12 |
| XD-03927 | 0.67 | 0.28 | 0.46 | 0.14 |
| XD-03932 | 0.72 | 0.23 | 0.65 | 0.05 |
| XD-03937 | 0.80 | 0.24 | 0.62 | 0.07 |
| XD-03942 | 0.72 | 0.14 | 0.79 | 0.08 |
| F-luc | 0.92 | 0.18 | 0.80 | 0.11 |
| Aha-1 | 0.77 | 0.10 | 0.69 | 0.09 |

In addition, transfection optimization studies were carried out with single transfection and double transfection. HepG2 cells were seeded in 24 well format (1.0×10⁵ cells/well). Single transfection was carried out using various amount (5 nM, 10 nM, 15 nM and 20 nM) of CEBPA-saRNA. AW1 and AW1+1 were tested, wherein the target of the two CEBPA-saRNAs are 1 nucleotide apart. AW1 refers AW01-5000000 and AW1+1 refers to AW01-51000 (aka AW1-51). Cells were harvested at 24 hr, 48 hr and 72 hr for qPCR analysis. Alternatively, double transfection method was employed. Reverse and forward transfections (double transfection) were carried out using various amount of CEBPA-saRNA (5 nM, 10 nM, 15 nM and 20 nM of AW1+1-CEBPA-saRNA). Cells were harvested following second transfection at 24 hr, 48 hr and 72 hr for qPCT analysis. With either the single transfection method or the double transfection method, optimized results were achieved with AW1+1.

CEBP-Luciferase reporter assay was carried out in HegG2 (P8) cells. The CEBP responsive element (ATT-GCGCAAT) was constructed with the luciferase reporter gene under the control of mCMV promoter. This was a dual reporter cassette and therefore had *Renilla* luciferase as the internal control for normalizing transfection efficiency and monitoring cell viability. This dual-CEBP(luc) reporter assay would then rapidly monitor CEBPA transcriptional activity in cells in response to AW50 v.s. AW51.

Seeding density was 1.5×10⁵ cells/well of 96 well format. 5% FCS (NO PSG) in 100 uL RPMI was used for primary seeding for reverse transfection. FCS refers to fetal calf serum used to supplement base media during cell culture. PSG refers Pencillin, Streptomycin and L-Glutamine. Pencilling and Streptomycin combination prevents growth of gram positive and gram negative bacteria. Lipofectamin 2000:saRNA:Luciferase construct complex was in 50 uL RPMI. Total volume/well was 150 uL. Scramble, AW-50 (aka CEBPA-AW1-500000) or AW51 (aka CEBPA-AW1-510000)) concentration was 10 ng/well. CEBPA-response-element-Luc-plasmid was 100 ng/well. CEBPA response element (CRE) plasmid contains tandem CRE repeats upstream of the Luciferase gene in addition to *Renilla* downstream of cytomegalovirus promoter to detect transfection efficiency. When CEBPA is transcribed and translated, it will bind to this reporter cassette and cause expression of Luciferase. CEBP-response element luciferase construct is commercially available from Qiagen (Catalogue CCS-001L). Full RPMI+10% FCS+PSG was used for forward transfection. Cells were harvested at 48 hour following forward transfection or 72 hour following initial seeding. 20 uL passive lysis buffer, 50 uL LARII Luc enzyme substrate, 50 uL Stop reaction for *Renilla* reading were used. LARII is the Luciferase Activating Reagent II as described by Promega (Catalogue E1910). The reagent contains the substrate (Luciferin) in addition to Magnesium and ATP that is required for enzymatic activity of luciferase to generate Luciferyl-AMP intermediate for the flash of light generated from the cells. Reading parameters were 2 sec pre-read delay followed by 10 sec measurement period. Results were shown in Table 27. CEBPA-Luc response was seen with both AW50 (avv RLU: 14.87) and AW51 (avv RLU: 24.20). Scramble induced CEBPA-Luc response had an avv RLU of 4.42. Therefore, AW50 (aka CEBPA-AW1-500000) and AW51 (aka CEBPA-AW1-510000) both showed up-regulation in luciferase reporter assay.

TABLE 27

CEBPA-Luciferase reporter assay

|  | 48 h Luciferase | 48 h Renilla | Luc:Ren | Luc:Ren relative to No-Luc + scrmbl |
|---|---|---|---|---|
| 1.CRE-Luc + AW50 | 36 | 22340 | 0.00161 | 11.17 |
| 1.CRE-Luc + AW50 | 9 | 3326 | 0.00271 | 18.76 |
| 1.CRE-Luc + AW50 | 12 | 5667 | 0.00212 | 14.68 |
| 2.CRE-Luc + AW51 | 20 | 8001 | 0.00250 | 17.33 |
| 2.CRE-Luc + AW51 | 22 | 6860 | 0.00321 | 22.23 |
| 2.CRE-Luc + AW51 | 35 | 7345 | 0.00477 | 33.04 |
| 3.CRE-Luc + Scrmbl | 8 | 12451 | 0.00064 | 4.45 |
| 3.CRE-Luc + Scrmbl | 16 | 24732 | 0.00065 | 4.49 |
| 3.CRE-Luc + Scrmbl | 8 | 12850 | 0.00062 | 4.32 |
| 4.Luc + AW50 | 7 | 10573 | 0.00066 | 4.59 |
| 4.Luc + AW50 | 12 | 20713 | 0.00058 | 4.02 |
| 4.Luc + AW50 | 6 | 15361 | 0.00039 | 2.71 |
| 5.Luc + AW51 | 8 | 56231 | 0.00014 | 0.99 |
| 5.Luc + AW51 | 3 | 140513 | 0.00002 | 0.15 |
| 5.Luc + AW51 | 5 | 33520 | 0.00015 | 1.03 |
| 6.Luc + Scrmbl | 2 | 107694 | 0.00002 | 0.13 |
| 6.Luc + Scrmbl | 21 | 92261 | 0.00023 | 1.58 |
| 6.Luc + Scrmbl | 13 | 69692 | 0.00019 | 1.29 |
| 7.POS-Luc | 154 | 110747 | 0.00139 | 9.64 |
| 7.POS-Luc | 83 | 37131 | 0.00224 | 15.50 |
| 7.POS-Luc | 169 | 54175 | 0.00312 | 21.63 |

Furthermore, peripheral blood mononuclear cell (PBMC) cytokine assays were conducted to measure immunocompetence. In vitro cytokine production by peripheral blood mononuclear cells (PBMCs) was measured as an indicator of immunocompetence. PBMC assays were carried out for various modifications of AW50 and AW51. Whole blood from 2 anonymous donors were obtained and pre-screened for infectious agents. Human peripheral blood mononuclear cells were isolated by centrifugation and plated in at ~100,000 cells per well. Transfection of saRNA was carried out using DOTAP. Supernatants were harvested ~20 hours after transfection and immediately assayed for IFN-α and TNF-α production by ELISA. Each treatment was analyzed in duplicate for all two donors. The sequences of the saRNAs were shown in Table 28 below.

TABLE 28

Sense sequence (lower case means 2'O-Me modification)

| Duplex-ID | Notes | Sense-ID | Sense Sequence | SEQ ID No. |
|---|---|---|---|---|
| XD-03287 | positive control |  |  |  |
| XD-03318 |  | X09348 | CUGAAAGGAUUCAUCCUCCUU | 296 |
| XD-03928 | XD-03287_IA_MiNA | X11267 | (invabasic)CgGuCaUuGuCaCuGgUCauu | 358 |
| XD-03929 | XD-03302_IA_MiNA | X11268 | (invabasic)GCgGuCaUuGuCaCuGgUCuu | 359 |
| XD-03933 | XD-03287_IA_AXO1 | X11272 | (invabasic)cgGuCAUUGuCACuGGUCAuu | 363 |
| XD-03934 | XD-03302_IA_AXO1 | X11273 | (invabasic)gcGgUCAUUgUCAcUGGUCuu | 364 |

Anti-sense sequence (lower case means 2'O-Me modification)

| Duplex-ID | Antisense-ID | Antisense Sequence | SEQ ID No. |
|---|---|---|---|
| XD-03287 |  |  |  |
| XD-03318 | X09349 | GGAGGAUGAAUCCUUUCAGUU | 334 |
| XD-03928 | X11282 | UGACCAGUGACAAUGACCGuu | 373 |

TABLE 28-continued

| XD-03929 | X11283 | GACCAGUGACAAUGACCGCuu | 374 |
| --- | --- | --- | --- |
| XD-03933 | X11282 | UGACCAGUGACAAUGACCGuu | 373 |
| XD-03934 | X11283 | GACCAGUGACAAUGACCGCuu | 374 |

In PBMC assay for TNF-α response, freshly isolated PBMCs were transfected with DOTAP (ds-RNAs). Blunt end 25 mer RNA (transfected), CpG-motive single strand oligonucleotide (direct incubation), chol-conjugated siRNA (direct incubation) were used as positive controls. Incubation time was 20 hrs. ELISA for hsTNF-α was performed. Results were shown in Table 29.

TABLE 29

| | 133 nM transfection | | | | | | |
| --- | --- | --- | --- | --- | --- | --- | --- |
| | medium | mock | XD-03287 | XD-03928 | XD-03933 | XD-03929 | XD-03934 | XD-03318 |
| Donor A | −0.36 | −0.69 | 0.36 | −0.93 | −1.95 | 1.66 | 0.08 | −0.89 |
| Donor B | −2.32 | −1.35 | −1.55 | −1.56 | −1.06 | −1.44 | 0.12 | −0.62 |
| | | | | Standard dev | | | | |
| Donor A | 0.01 | 1.17 | 2.76 | 0.70 | 0.56 | 0.43 | 0.81 | 0.09 |
| Donor B | 0.62 | 0.28 | 0.40 | 0.76 | 0.43 | 0.06 | 0.03 | 1.05 |

| | | | 500 nM direct incubation | |
| --- | --- | --- | --- | --- |
| | blunt end pos. Ctrl | neg. ctrl | CpG pos. Ctrl | chol pos. Ctrl |
| Donor A | 0.45 | −0.79 | 2.00 | 12.63 |
| Donor B | 2.43 | −0.58 | 11.18 | 14.36 |
| | | Standard dev | | |
| Donor A | 0.08 | 0.98 | 2.01 | 1.86 |
| Donor B | 1.48 | 0.92 | 2.43 | 0.56 |

In PBMC assay for INF-α response, freshly isolated PBMCs were transfected with Geneporter-2 control (ds-RNAs). Blunt end 25 mer RNA (transfected), CpG-motive single strand oligonucleotide (direct incubation), chol-conjugated siRNA (direct incubation) were used as positive controls. Incubation time was 20 hrs. ELISA for hsINF-α was performed. Results were shown in Table 30.

TABLE 30

| | 133 nM transfection | | | | | | |
| --- | --- | --- | --- | --- | --- | --- | --- |
| | medium | mock | XD-03287 | XD-03928 | XD-03933 | XD-03929 | XD-03934 | XD-03318 |
| Donor A | −42.20 | −50.14 | −37.32 | −42.97 | −58.13 | −59.72 | −51.80 | −47.21 |
| Donor B | −55.18 | −48.13 | −51.21 | −60.37 | −48.39 | −33.36 | −48.42 | −43.46 |
| | | | | standard dev. | | | | |
| Donor A | 1.08 | 5.30 | 11.85 | 7.60 | 7.18 | 14.22 | 16.03 | 7.20 |
| Donor B | 11.24 | 13.74 | 13.88 | 5.60 | 1.71 | 7.22 | 2.32 | 0.04 |

| | | | 500 nM direct icubation | |
| --- | --- | --- | --- | --- |
| | blunt end pos. Ctrl | neg. ctrl | CpG pos. Ctrl | chol pos. Ctrl |
| Donor A | 52.96 | −66.08 | 44.89 | 245.88 |
| Donor B | 56.20 | −47.25 | 233.03 | 87.43 |
| | | standard dev. | | |
| Donor A | 7.75 | 0.48 | 2.49 | 5.30 |
| Donor B | 3.73 | 4.08 | 3.70 | 0.88 |

Other Embodiments

It is to be understood that while the present disclosure has been described in conjunction with the detailed description thereof, the foregoing description is intended to illustrate and not limit the scope of the present disclosure, which is defined by the scope of the appended claims. Other aspects, advantages, and modifications are within the scope of the following claims.

SEQUENCE LISTING (385 sequences)

SEQ ID NO: 1 - RNA, 19 nt, Artificial Sequence
  source: /note="Description of Artificial Sequence: Synthetic oligonucleotide"
cggucauugucacugguca

SEQ ID NO: 2 - RNA, 19 nt, Artificial Sequence
  source: /note="Description of Artificial Sequence: Synthetic oligonucleotide"
ugaccagugacaaugaccg

SEQ ID NO: 3 - RNA, 19 nt, Artificial Sequence
  source: /note="Description of Artificial Sequence: Synthetic oligonucleotide"
agcugaaaggauucauccu

SEQ ID NO: 4 - RNA, 19 nt, Artificial Sequence
  source: /note="Description of Artificial Sequence: Synthetic oligonucleotide"
aggaugaauccuuccagcu

SEQ ID NO: 5 - RNA, 19 nt, Artificial Sequence
  source: /note="Description of Artificial Sequence: Synthetic oligonucleotide"
acauagucccagugauuaa

SEQ ID NO: 6 - RNA, 19 nt, Artificial Sequence
  source: /note="Description of Artificial Sequence: Synthetic oligonucleotide"
uuaaucacugggacuaugu

SEQ ID NO: 7 - RNA, 19 nt, Artificial Sequence
  source: /note="Description of Artificial Sequence: Synthetic oligonucleotide"
gaauaagacuuuguccaau

SEQ ID NO: 8 - RNA, 19 nt, Artificial Sequence
  source: /note="Description of Artificial Sequence: Synthetic oligonucleotide"
auuggacaaagucuuauuc

SEQ ID NO: 9 - RNA, 19 nt, Artificial Sequence
  source: /note="Description of Artificial Sequence: Synthetic oligonucleotide"
gcgcggauucucuuucaaa

SEQ ID NO: 10 - RNA, 19 nt, Artificial Sequence
  source: /note="Description of Artificial Sequence: Synthetic oligonucleotide"
uuugaaagagaauccgcgc

SEQ ID NO: 11 - RNA, 19 nt, Artificial Sequence
  source: /note="Description of Artificial Sequence: Synthetic oligonucleotide"
ccaggaacucgucguugaa

SEQ ID NO: 12 - RNA, 19 nt, Artificial Sequence
  source: /note="Description of Artificial Sequence: Synthetic oligonucleotide"
uucaacgacgaguuccugg

SEQ ID NO: 13 - RNA, 19 nt, Artificial Sequence
  source: /note="Description of Artificial Sequence: Synthetic oligonucleotide"
agaaguuggccacuuccau

SEQ ID NO: 14 - RNA, 19 nt, Artificial Sequence
  source: /note="Description of Artificial Sequence: Synthetic oligonucleotide"
auggagucggccgacuucu

SEQ ID NO: 15 - RNA, 19 nt, Artificial Sequence
  source: /note="Description of Artificial Sequence: Synthetic oligonucleotide"
aagaggucggagaggaagu

SEQ ID NO: 16 - RNA, 19 nt, Artificial Sequence
  source: /note="Description of Artificial Sequence: Synthetic oligonucleotide"
aguuccuggccgaccuguu

SEQ ID NO: 17 - RNA, 19 nt, Artificial Sequence
  source: /note="Description of Artificial Sequence: Synthetic oligonucleotide"
uuguacucgucgcugugcu

SEQ ID NO: 18 - RNA, 19 nt, Artificial Sequence
  source: /note="Description of Artificial Sequence: Synthetic oligonucleotide"
agaacagcaacgaguaccg

SEQ ID NO: 19 - RNA, 19 nt, Artificial Sequence
  source: /note="Description of Artificial Sequence: Synthetic oligonucleotide"
uacucgucgcugugcuugu

SEQ ID NO: 20 - RNA, 19 nt, Artificial Sequence
  source: /note="Description of Artificial Sequence: Synthetic oligonucleotide"
acaagaacagcaacgagua

SEQ ID NO: 21 - DNA, 25 bp, Artificial Sequence
  source: /note="Description of Artificial Sequence: Synthetic oligonucleotide"
  source: /note="Description of Combined DNA/RNA Molecule: Synthetic oligonucleotide"
agaaguuggccacuuccauggggga

SEQ ID NO: 22 - DNA, 27 bp, Artificial Sequence
  source: /note="Description of Artificial Sequence: Synthetic oligonucleotide"
  source: /note="Description of Combined DNA/RNA Molecule: Synthetic oligonucleotide"
tcccccauggagucggccgacuucuac

SEQ ID NO: 23 - DNA, 25 bp, Artificial Sequence
  source: /note="Description of Artificial Sequence: Synthetic oligonucleotide"
  source: /note="Description of Combined DNA/RNA Molecule: Synthetic oligonucleotide"
aagaggucggagaggaagucgucgt

SEQ ID NO: 24 - DNA, 27 bp, Artificial Sequence
  source: /note="Description of Artificial Sequence: Synthetic oligonucleotide"
  source: /note="Description of Combined DNA/RNA Molecule: Synthetic oligonucleotide"
acgacgaguuccuggccgaccuguucc

SEQ ID NO: 25 - DNA, 25 bp, Artificial Sequence
  source: /note="Description of Artificial Sequence: Synthetic oligonucleotide"
  source: /note="Description of Combined DNA/RNA Molecule: Synthetic oligonucleotide"
uuguacucgucgcugugcuugucca

SEQ ID NO: 26 - DNA, 27 bp, Artificial Sequence
  source: /note="Description of Artificial Sequence: Synthetic oligonucleotide"
  source: /note="Description of Combined DNA/RNA Molecule: Synthetic oligonucleotide"
tggacaagaacagcaacgaguaccggg

SEQ ID NO: 27 - DNA, 25 bp, Artificial Sequence
  source: /note="Description of Artificial Sequence: Synthetic oligonucleotide"
  source: /note="Description of Combined DNA/RNA Molecule: Synthetic oligonucleotide"
uacucgucgcugugcuuguccaccg

SEQ ID NO: 28 - DNA, 27 bp, Artificial Sequence
  source: /note="Description of Artificial Sequence: Synthetic oligonucleotide"
  source: /note="Description of Combined DNA/RNA Molecule: Synthetic oligonucleotide"
cgguggacaagaacagcaacgaguacc

SEQ ID NO: 29 - RNA, 21 nt, Artificial Sequence
  source: /note="Description of Artificial Sequence: Synthetic oligonucleotide"
cugaguaaucgcuuaaagauu

SEQ ID NO: 30 - RNA, 21 nt, Artificial Sequence
  source: /note="Description of Artificial Sequence: Synthetic oligonucleotide"
ucuuuaagcgauuacucaguu

SEQ ID NO: 31 - RNA, 21 nt, Artificial Sequence
  source: /note="Description of Artificial Sequence: Synthetic oligonucleotide"
gaaacuuuagcgagucagauu

SEQ ID NO: 32 - RNA, 21 nt, Artificial Sequence
  source: /note="Description of Artificial Sequence: Synthetic oligonucleotide"
ucugacucgcuaaaguuucuu

SEQ ID NO: 33 - RNA, 21 nt, Artificial Sequence
  source: /note="Description of Artificial Sequence: Synthetic oligonucleotide"
acuacugagugacaguagauu

SEQ ID NO: 34 - RNA, 20 nt, Artificial Sequence
  source: /note="Description of Artificial Sequence: Synthetic oligonucleotide"
ucuacugucacucaguaguu

SEQ ID NO: 35 - DNA, 891 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttt

SEQ ID NO: 36 - DNA, 2535 bp, Homo sapiens
gaggggccgaggccagccccggagaggagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacaaaaaaaaaaaaaaaa

SEQ ID NO: 37 - DNA, 2938 bp, Homo sapiens
gagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcggattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttattaaa

SEQ ID NO: 38 - DNA, 5472 bp, Homo sapiens
cccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaaaaaaaaaaaaaaaaaaaaa

SEQ ID NO: 39 - DNA, 7479 bp, Homo sapiens
tcctcagaggcaggaaatactttccaggcaatctgggcctggttgtggaggccccttttgcaaaacctcagtctgaatttagtagacagaagtcactaggaatgccttgacaggatcctgccttagctaaggctccctccagctgcagagggtgtttttgttagactcacacactgcgtgaaactgctcagaatagagccatgatctcaaccacgaaatgggaacttagattttggagaaactaacggggacggacttctttcctagcctgagtgttgagcagtgtcatgccttggcgtttcagctcctcgttgtctaggtggtgaaatgacagaactcattcgcttctttgattggtgattttgaaataatctttcatcaagttccatctcctttaccctcatatggaatatatctctctgtctgttgttaaactacgatgacatgtctgtagctatcagaaagagaagctgggaagaacatgtgacccactggatgggacagccttttaattctgatgatcgtaacacagcatgtcatcatggactagtagctgacagcttgcaggcaagtatggaaaaagatgcaactctaaatgtggaccgcaaagagaagtgtgtttcactacctgactgctgtcatggatcagagctgagagattttcctgggaggccaatgggtcatctttcaaaggatgtggacgaaaatgacagccatgaaggtgaagatcagtttctttctctggaagccagcacagaaacactagtgcatgtttctgatgaggataacaatgctgatttatgccttacagatgataaacaggttttaaatacccaagggcagaaaacatcaggccaacatatgatccaaggagcaggctccttagaaaaggcactgcccatcatacaaagtaaccaagtttcttctaactcctggggaatagctggtgaaactgaattagcactggtaaaagaaagtggggagagaaaagttactgactctataagtaaaagcctggagctttgcaatgaaataagcttaagtgaaataaaagatgcacccaaagtaaatgcagtggatactttgaacgtgaaagatattgcacctgagaaacaattgcttaactctgctgtaattgctcagcaacgaaggaaacctgacccccctaaagatgaaaatgaaagaagcacctgcaatgtagtacaaaatgagttcttggatactccttgcacaaacagaggactgccattattaaaaacagattttggaagctgccttctgcagcctccttcctgccccaatggaatgtcagctgaaaatggcctggagaagagtggtttttcacaacatcaaaacaaaagtccaccaaaggtcaaggcagaagatggcatgcagtgtttacaattaaaggagaccctggccacccaggaacccacagataaccaagtcagacttcgtaagagaaaggaaataagagaagatcgagatagggcgcggctggactccatggtgctgctgattatgaaactggaccagcttgatcaggacatagaaaatgccctcagcaccagctcctctccatcaggcacaccaacaaacctgcggcggcacgttcctgatctggaatcaggatctgaaagtggagcagataccatttcagtaaatcagacacgagtaaatttgtcttctgacactgagtccacggacctcccatcttccactccagtagccaattctggaaccaaacccaagactacggctattcaaggtatttcagagaaggaaaaggctgaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactg

SEQ ID NO: 40 - DNA, 2755 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtaaaaaaaaaaaaaaaaaaaaaaaaaaaaaaaaaaaaaaaaaaaaaaaaaaaaaaaaaaaaaaaaaaa

SEQ ID NO: 41 - DNA, 1122 bp, Homo sapiens
gaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatcctgaattccagcaaaagagctattgccaaccagtttgaagaccgccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaaaaaaaaaaaaaaaaaaaaaaaaaaaaaaaaaaaaaaaaaaaaa

SEQ ID NO: 42 - DNA, 1393 bp, Homo sapiens
tcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagatgcagacggtgaccgccgcggtggaggagcttttggtggccgctcagcgccaggatcgcctcacagtgggggtgtacgagtcggccaagttgatgaatgtggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacgaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatccgatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctgaaaaaaaaaaaaaaaaaa

SEQ ID NO: 43 - DNA, 3555 bp, Homo sapiens
ggccgccggggcccgggggacgcgctcgcgcgggggccgccccctccccttccctccaccctgggcgggggcgcgcgagaagcggtgacgtcaaggggcgcgctgtggcagcacctccccgcgcgctagttaaaaagaagaagaaaagagggaacgaaacatgagaggctgtgtgagaagctgcagccgccggcagaggagacctcagcatcatctagagcccagcgctggccctgcctccgcctgccccgccgccgccgtcgccgtttctgttcctgctactgtcccacctaaacaactcccgttacacggacaagtgaacatctgtggctgtcctctccttttcttcctcctcttccaactccttctcctcctcccacttcccagccgcagcagaaagcccccaacccaactgacactggcacaactgcaaacggtgtcatccgcacaactttatctcgctcctcgggctcccctaaggcattggacccatcgccgcgtcttttattttttgcaaagttgcatcgctgtacatatttttgtccccgccacctccctctgtctctggagtgccctacagccccgcaaactcctcctggagctgcgccctagtgcccctgctgggcagtggcgttcccccccatcctcccgcgcccagcccctgctgctctgggcagacgatgctgaagatgctctcctttaagctgctgctgctggccgtggctctgggcttctttgaaggagatgctaagtttggggaaagaaacgaagggagcggagcaaggaggagaaggtgcctgaatgggaaccccccgaagcgcctgaaaaggagagacaggaggatgatgtcccagctggagctgctgagtgggggagagatgctgtgcggtggcttctaccctcggctgtcctgctgcctgcggagtgacagcccggggctagggcgcctggagaataagatattttctgttaccaacaacacagaatgtgggaagttactggaggaaatcaaatgtgcactttgctctccacattctcaaagcctgttccactcacctgagagagaagtcttggaaagagacctagtacttcctctgctctgcaaagactattgcaaagaattcttttacacttgccgaggccatattccaggtttccttcaaacaactgcggatgagttttgcttttactatgcaagaaaagatggtgggttgtgctttccagattttccaagaaaacaagtcagaggaccagcatctaactacttggaccagatggaagaatatgacaaagtggaagagatcagcagaaagcacaaacacaactgcttctgtattcaggaggttgtgagtgggctgcggcagcccgttggtgccctgcatagtggggatggctcgcaacgtctcttcattctggaaaaagaaggttatgtgaagatacttacccctgaaggagaaattttcaaggagccttatttggacattcacaaacttgttcaaagtggaataaagggaggagatgaaagaggactgctaagcctcgcattccatcccaattacaagaaaaatggaaagttgtatgtgtcctataccaccaaccaagaacggtgggctatcgggcctcatgaccacattcttagggttgtggaatacacagtatccagaaaaaatccacaccaagttgatttgagaacagccagagtctttcttgaagttgcagaactccacagaaagcatctgggaggacaactgctctttggccctgacggctttttgtacatcattcttggtgatgggatgattacactggatgatatggaagaaatggatgggttaagtgatttcacaggctcagtgctacggctggatgtggacacagacatgtgcaacgtgccttattccataccaaggagcaacccacacttcaacagcaccaaccagccccccgaagtgtttgctcatgggctccacgatccaggcagatgtgctgtggatagacatcccactgatataaacatcaatttaacgatactgtgttcagactccaatggaaaaaacagatcatcagccagaattctacagataataaaggggaaagattatgaaagtgagccatcacttttagaattcaagccattcagtaatggtcctttggttggtggatttgtataccggggctgccagtcagaaagattgtatggaagctacgtgtttggagatcgtaatgggaatttcctaactctccagcaaagtcctgtgacaaagcagtggcaagaaaaaccactctgtctcggcactagtgggtcctgtagaggctacttttccggtcacatcttgggatttggagaagatgaactaggtgaagtttacattttatcaagcagtaaaagtatgacccagactcacaatggaaaactctacaaaattgtagatcccaaaagacctttaatgcctgaggaatgcagagccacggtacaacctgcacagacactgacttcagagtgctccaggctctgtcgaaacggctactgcacccccacgggaaagtgctgctgcagtccaggctgggagggggacttctgcagaactgcaaaatgtgagccagcatgtcgtcatggaggtgtctgtgttagaccgaacaagtgcctctgtaaaaaaggatatcttggtcctcaatgtgaacaagtggacagaaacatccgcagagtgaccagggcaggtattcttgatcagatcattgacatgacatcttacttgctggatctaacaagttacattgtatagtttctgggactgtttgaatattctattccaatgggcatttattttttatcctgtcattaaaaaaaaaagactgttatcctgctacacactcctgtgatttcattctcttttattaatttaaaaataatttccagaaatgtgcagatcctctgtgtgtatgtcagcatgtttgttcacatatgcacatacacatactcataacccctatatgcgttgttgcataacagatgattttttaaaatatatacttccttatgcaaagtaatttacacagaaattccattgtaaattgataatggattttttatgttactagaagagattatttgacttcccaggaattttctgtctgtaatcactaaagtcaactttaatagagttttgaaacagtactgtgcaatccgatggatctaattaaaaaaaaggcaatatttttatattaaagtactatactaggagagaatgtttcagaactccctgatgaatttctaagtgagcaacttgatataaaattgtaatcttcatttttgtcagtgtatccagttacagaatgctacacacttacctttttattggctgagaaatctggttatttcatcttaatctcaagattgttttcaagtgttttataattaaatcataatagcatattttaaaatcaatcttcctaaaaggtctgcttttattgtatattttatttaacaataggcactgggtttgtgttacatatttatatattttattttatttttataatatagacatcacctag

SEQ ID NO: 44 - DNA, 5182 bp, Homo sapiens
cgcctgtccccctcccgaggcccgggctcgcgacggcagagggctccgtcggcccaaaccgagctgggcgcccgcggtccgggtgcagcctccactccgccccccagtcaccgcctcccccggcccctcgacgtggcgcccttccctccgcttctctgtgctccccgcgcccctcttggcgtctggccccggcccccgctctttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcaaaacattaaactaacccccttcccccccccccacaacaaccctcttaaaactaattggctttttagaaacaccccacaaaagctcagaaattggctttaaaaaaaacaaccaccaaaaaaaatcaattggctaaaaaaaaaaagtattaaaaacgaattggctgagaaacaattggcaaaataaaggaatttggcactccccacccccctctttctcttctcccttggactttgagtcaaattggcctggacttgagtccctgaaccagcaaagagaaaagaaggaccccagaaatcacaggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcacccccaaatcttacatctcaattcccatcctaaaaagcactcatactttatgcatccccgcagctacacacacacaacacacagcacacgcatgaacacagcacacacacgagcacagcacacacacaaacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcacacacatgcacacacagcacacacgcatgcacagcacacatgaacacagcacacacacaaacacacagcacacacatgcacacacagcacacacactcatgcgcagcacatacatgaacacagctcacagcacacaaacacgcagcacacacgttgcacacgcaagcacccacctgcacacacacatgcgcacacacacgcacacccccacaaaattggatgaaaacaataagcatatctaagcaactacgatatctgtatggatcaggccaaagtcccgctaagattctccaatgttttcatggtctgagccccgctcctgttcccatctccactgcccctcggccctgtctgtgccctgcctctcagaggagggggctcagatggtgcggcctgagtgtgcggccggcggcatttgggatacacccgtagggtgggcggggtgtgtcccaggcctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatgcggggagtgtgggaagtctggcggttggaggggtgggtggggggcagtgggggctgggcggggggagttctggggtaggaagtggtcccgggagattttggatggaaaagtcaggaggattgacagcagacttgcagaattacatagagaaattaggaacccccaaatttcatgtcaattgatctattccccctctttgtttcttggggcatttttccttttttttttttttttgttttttttttacccctccttagctttatgcgctcagaaaccaaattaaaccccccccccatgtaacaggggggcagtgacaaaagcaagaacgcacgaagccagcctggagaccaccacgtcctgccccccgccatttatcgccctgattggattttgtttttcatctgtccctgttgcttgggttgagttgagggtggagcctcctggggggcactggccactgagcccccttggagaagtcagaggggagtggagaaggccactgtccggcctggcttctggggacagtggctggtccccagaagtcctgagggcggaggggggggttgggcagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagagcaggagagctgccaggtctgcccatcgaccaggttgcttgggccccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcctttaacgctaatatttccggcaaaatcccatgcttgggttttgtctttaaccttgtaacgcttgcaatcccaataaagcattaaaagtcatgaaaaaaaaaaaaaaaaaa

SEQ ID NO: 45 - DNA, 3620 bp, Homo sapiens
agcgccggcgaggcgcgggaggaggagaagcagtggggaggcgcagccgctcacctgcggggcagggcgcggaggagggacccgggctgcgcgctctcgggccgaggaaccaggacgcgcccggagcctcgcacgcggccaagctcggggcgtcccctcccctcggccgggcgaactcaaggggcgcagctctttgctttgacagagctggccggcggaggcgtgcagagcggcgagccggcgagccaggctgagaaactcgagccgggaacaaagaggggtcggactgagtgtgtgtgtcggctcgagctccgggcagaggcatttgggcccgaggcccccgctgtgactccccgagactccgcagtgccctccactgcggagtccccgcgcttgccggcaaaaactttattcttggcaaacttctctttctcttcccctcctcctcggcccccatcttctgctcctcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcgggggcgggcgcctgcgtcggtctccgcgaagcgggaaagcgcggcggccgccgggattcgggcgccgcggcagctgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcggcgggggggacccggaactctgcgccacggacgagatgatccccttcaaggacgagggcgatcctcagaaggaaaagatcttcgccgagatcagtcatcccgaagaggaaggcgatttagctgacatcaagtcttccttggtgaacgagtctgaaatcatcccggccagcaacggacacgaggtggccagacaagcacaaacctctcaggagccctaccacgacaaggccagagaacaccccgatgacggaaagcatccagatggaggcctctacaacaagggaccctcctactcgagttattccgggtacataatgatgccaaatatgaataacgacccatacatgtcaaatggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagacatcctccagctcctgatatccctactttttatcccttgtctccgggtggtgttggacagatcaccccacctcttggctggcaaggtcagcctgtatatcccatcacgggtggattcaggcaaccctacccatcctcactgtcagtcgacacttccatgtccaggttttcccatcatatgattcccggtcctcctggtccccacacaactggcatccctcatccagctattgtaacacctcaggtcaaacaggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagctatcaaccagattcttggcagaaggtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaaagttctggaaaagtttgaaataatgacataaaaagaagccttctttttctgagacagcttgtctggtaagtggcttctctgtgaattgcctgtaacacatagtggcttctccgcccttgtaaggtgttcagtagagctaaataaatgtaatagccaaacccactctgttggtagcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatgttctgtatttgtatctgtttttattagccaattagtgggattttatgccagttgttaaaatgagcattgatgtacccattttttaaaaaagcaaggcacagcctttgcccaaaactgtcatcctaacgtttgtcattccagtttgagttaatgtgctgagcatttttttaaaagaagctttgtaataaaacatttttaaaaattgtcatttaaaaaaaaaaaaaaaaaa

SEQ ID NO: 46 - DNA, 5572 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttgcaatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcaaaaaaaaaaaaaaaaaaaaaaaaaaa

SEQ ID NO: 47 - DNA, 4600 bp, Homo sapiens
gcgcacgcgcgcgggcccgcgccgacgcagcacggcctcgagggcgcgagcccgcgccgccgccgccgccgccggtcccggaccactgtgagcccgcggcgtgaggcgtgggaggaagcgcggctgctgtcgcccagcgccgccccgtcgtcgtctgccttcgcttcacggcgccgagccgcggtccgagcagaactggggctcccttgcatcttccagttacaaattcagtgccttctgcagtttccccagagctcctcaagaataacggaagggagaatatgacagatacctagcatctagcaaaataatggcagctgcttaccttgaccccaacttgaatcacacaccaaattcgagtactaagactcacctgggtactggtatggaacgttctcctggtgcaatggagcgagtattaaaggtctttcattattttgaaagcaatagtgagccaaccacctgggccagtattatcaggcatggagatgctactgatgtcaggggcatcattcagaagatagtggacagtcacaaagtaaagcatgtggcctgctatggattccgcctcagtcacctgcggtcagaggaggttcactggcttcacgtggatatgggcgtctccagtgtgagggagaagtatgagcttgctcacccaccagaggagtggaaatatgaattgagaattcgttatttgccaaaaggatttctaaaccagtttactgaagataagccaactttgaatttcttctatcaacaggtgaagagcgattatatgttagagatagctgatcaagtggaccaggaaattgctttgaagttgggttgtctagaaatacggcgatcatactgggagatgcggggcaatgcactagaaaagaagtctaactatgaagtattagaaaaagatgttggtttaaagcgattttttcctaagagtttactggattctgtcaaggccaaaacactaagaaaactgatccaacaaacatttagacaatttgccaaccttaatagagaagaaagtattctgaaattctttgagatcctgtctccagtctacagatttgataaggaatgcttcaagtgtgctcttggttcaagctggattatttcagtggaactggcaatcggcccagaagaaggaatcagttacctaacggacaagggctgcaatcccacacatcttgctgacttcactcaagtgcaaaccattcagtattcaaacagtgaagacaaggacagaaaaggaatgctacaactaaaaatagcaggtgcacccgagcctctgacagtgacggcaccatccctaaccattgcggagaatatggctgacctaatagatgggtactgccggctggtgaatggaacctcgcagtcatttatcatcagacctcagaaagaaggtgaacgggctttgccatcaataccaaagttggccaacagcgaaaagcaaggcatgcggacacacgccgtctctgtgtcagaaacagatgattatgctgagattatagatgaagaagatacttacaccatgccctcaaccagggattatgagattcaaagagaaagaatagaacttggacgatgtattggagaaggccaatttggagatgtacatcaaggcatttatatgagtccagagaatccagctttggcggttgcaattaaaacatgtaaaaactgtacttcggacagcgtgagagagaaatttcttcaagaagccttaacaatgcgtcagtttgaccatcctcatattgtgaagctgattggagtcatcacagagaatcctgtctggataatcatggagctgtgcacacttggagagctgaggtcatttttgcaagtaaggaaatacagtttggatctagcatctttgatcctgtatgcctatcagcttagtacagctcttgcatatctagagagcaaaagatttgtacacagggacattgctgctcggaatgttctggtgtcctcaaatgattgtgtaaaattaggagactttggattatcccgatatatggaagatagtacttactacaaagcttccaaaggaaaattgcctattaaatggatggctccagagtcaatcaattttcgacgttttacctcagctagtgacgtatggatgtttggtgtgtgtatgtgggagatactgatgcatggtgtgaagccttttcaaggagtgaagaacaatgatgtaatcggtcgaattgaaaatggggaaagattaccaatgcctccaaattgtcctcctaccctctacagccttatgacgaaatgctgggcctatgaccccagcaggcggcccaggtttactgaacttaaagctcagctcagcacaatcctggaggaagagaaggctcagcaagaagagcgcatgaggatggagtccagaagacaggccacagtgtcctgggactccggagggtctgatgaagcaccgcccaagcccagcagaccgggttatcccagtccgaggtccagcgaaggattttatcccagcccacagcacatggtacaaaccaatcattaccaggtttctggctaccctggttcacatggaatcacagccatggctggcagcatctatccaggtcaggcatctcttttggaccaaacagattcatggaatcatagacctcaggagatagcaatgtggcagcccaatgtggaggactctacagtattggacctgcgagggattgggcaagtgttgccaacccatctgatggaagagcgtctaatccgacagcaacaggaaatggaagaagatcagcgctggctggaaaaagaggaaagatttctgaaacctgatgtgagactctctcgaggcagtattgacagggaggatggaagtcttcagggtccgattggaaaccaacatatatatcagcctgtgggtaaaccaggtaaagaagaaaagaattgggcggaaagaaatcctgcagctccaccaaagaaaccgcctcgccctggagctcccggtcatctgggaagccttgccagcctcagcagccctgctgacagctacaacgagggtgtcaagccatggaggcttcagccccaggaaatcagcccccctcctactgccaacctggaccggtcgaatgataaggtgtacgagaatgtgacgggcctggtgaaagctgtcatcgagatgtccagtaaaatccagccagccccaccagaggagtatgtccctatggtgaaggaagtcggcttggccctgaggacattattggccactgtggatgagaccattcccctcctaccagccagcacccaccgagagattgagatggcacagaagctattgaactctgacctgggtgagctcatcaacaagatgaaactggcccagcagtatgtcatgaccagcctccagcaagagtacaaaaagcaaatgctgactgctgctcacgccctggctgtggatgccaaaaacttactcgatgtcattgaccaagcaagactgaaaatgcttgggcagacgagaccacactgagcctcccctaggagcacgtcttgctaccctcttttgaagatgttctctagccttccaccagcagcgaggaattaaccctgtgtcctcagtcgccagcacttacagctccaacttttttgaatgaccatctggttgaaaaatctttctcatataagtttaaccacactttgatttgggttcattttttgttttgtttttttcaatcatgatattcagaaaaatccaggatccaaaatgtggcgtttttctaagaatgaaaattatatgtaagcttttaagcatcatgaagaacaatttatgttcacattaagatacgttctaaagggggatggccaaggggtgacatcttaattcctaaactaccttagctgcatagtggaagaggagagcatgaagcaaagaattccaggaaacccaagaggctgagaattcttttgtctaccatagaattattatccagactggaatttttgtttgttagaacacccttcagttgcaatatgctaatcccactttacaaagaatataaaagctatattttgaagacttgagttatttcagaaaaaactacagccctttttgtcttacctgccttttactttcgtgtggatatgtgaagcattgggtcgggaactagctgtagaacacaactaaaaactcatgtcttttttcacagaataatgtgccagttttttgtagcaatgttatttctcttggaagcagaaatgctttgtaccagagcacctccaaactgcattgaggagaagttccagaaccatcccctttttccatttttatataatttataaagaaagattaaagccatgttgactattttacagccactggagttaactaacccttccttgtatctgtcttcccaggagagaatgaagcaaaacaggaatttggttttcttttgatgtccagttacaccatccattctgttaattttgaaaaaatataccctccctttagtttgttgggggatataaattattctcaggaagaatataatgaactgtacagttactttgacctattaaaaaggtgttaccagtaaagttcttgttgtaatatccttaaaaaaaa

SEQ ID NO: 48 - DNA, 4772 bp, Homo sapiens
gctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaa

SEQ ID NO: 49 - DNA, 4340 bp, Homo sapiens
attcattcattccccgtggcactggaggcggcccactctgctctgtcagcttcggagctcctccaccctggctgccgaaagccccttcccgccatctaatgatacactctgcatacgcttctgttgagaatttgtggctagacattcctgtgggaccgggaatccaaattcttgggtacaaacagaaacttactttccttggggatttttttctctctctcactcacacacactctcgcgttctttccttttttctttttcgtagcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggcatggcatcgaacagcatcttcgactccttcccgacctactcgccgaccttcatccgcgacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaagga

SEQ ID NO: 50 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 51 - DNA, 2737 bp, Homo sapiens
gcggctccgacttggactccctgctccgctgctgccgcttcggccccgcacgcagccagccgccagccgcccgcccggcccagctcccgccgcggccccttgccgcggtccctctcctggtcccctcccggttggtccgggggtgcgcagggggcagggcgggcgcccaggggaagctcgagggacgcgcgcgcgaaggctcctttgtggacttcacggccgccaacatctgggcgcagcgcgggccaccgctggccgtctcgccgccgcgtcgccttggggacccgagggggctcagccccaaggacggagacttcgattcgggaccagccccccgggatgcggtagcggccgctgtgcggaggccgcgaagcagctgcagccgccgccgcgcagatccacgctggctccgtgcgccatggtcacccacagcaagtttcccgccgccgggatgagccgccccctggacaccagcctgcgcctcaagaccttcagctccaagagcgagtaccagctggtggtgaacgcagtgcgcaagctgcaggagagcggcttctactggagcgcagtgaccggcggcgaggcgaacctgctgctcagtgccgagcccgccggcacctttctgatccgcgacagctcggaccagcgccacttcttcacgctcagcgtcaagacccagtctgggaccaagaacctgcgcatccagtgtgaggggggcagcttctctctgcagagcgatccccggagcacgcagcccgtgccccgcttcgactgcgtgctcaagctggtgcaccactacatgccgccccctggagccccctccttcccctcgccacctactgaaccctcctccgaggtgcccgagcagccgtctgcccagccactccctgggagtccccccagaagagcctattacatctactccgggggcgagaagatccccctggtgttgagccggcccctctcctccaacgtggccactcttcagcatctctgtcggaagaccgtcaacggccacctggactcctatgagaaagtcacccagctgccggggcccattcgggagttcctggaccagtacgatgccccgctttaaggggtaaagggcgcaaagggcatgggtcgggagaggggacgcaggcccctctcctccgtggcacatggcacaagcacaagaagccaaccaggagagagtcctgtagctctggggggaaagagggcggacaggcccctccctctgccctctccctgcagaatgtggcaggcggacctggaatgtgttggagggaagggggagtaccacctgagtctccagcttctccggaggagccagctgtcctggtgggacgatagcaaccacaagtggattctccttcaattcctcagcttcccctctgcctccaaacaggggacacttcgggaatgctgaactaatgagaactgccagggaatcttcaaactttccaacggaacttgtttgctctttgatttggtttaaacctgagctggttgtggagcctgggaaaggtggaagagagagaggtcctgagggccccagggctgcgggctggcgaaggaaatggtcacaccccccgcccaccccaggcgaggatcctggtgacatgctcctctccctggctccggggagaagggcttggggtgacctgaagggaaccatcctggtaccccacatcctctcctccgggacagtcaccgaaaacacaggttccaaagtctacctggtgcctgagagcccagggcccttcctccgttttaagggggaagcaacatttggaggggatggatgggctggtcagctggtctccttttcctactcatactataccttcctgtacctgggtggatggagcgggaggatggaggagacgggacatctttcacctcaggctcctggtagagaagacaggggattctactctgtgcctcctgactatgtctggctaagagattcgccttaaatgctccctgtcccatggagagggacccagcataggaaagccacatactcagcctggatgggtggagaggctgagggactcactggagggcaccaagccagcccacagccagggaagtggggagggggggcggaaacccatgcctcccagctgagcactgggaatgtcagcccagtaagtattggccagtcaggcgcctcgtggtcagagcagagccaccaggtcccactgccccgagccctgcacagccctccctcctgcctgggtgggggaggctggaggtcattggagaggctggactgctgccaccccgggtgctcccgctctgccatagcactgatcagtgacaatttacaggaatgtagcagcgatggaattacctggaacagttttttgtttttgtttttgtttttgtttttgtgggggggggcaactaaacaaacacaaagtattctgtgtcaggtattgggctggacagggcagttgtgtgttggggtggtttttttctctatttttttgtttgtttcttgttttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcagtaatttataataaagagcactattttttaatgaaaaac

SEQ ID NO: 52 - DNA, 4704 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 53 - DNA, 1953 bp, Homo sapiens
acagaacccagaaaaacaactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctattcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagagcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaaaaaaaaaaaaaaacttcagtaagtacgtgttatttttttcaataaaattctattacagtatgtcatgtttgctgtagtgctcatatttattgttgtttttgttttagtactcacttgtttcataatatcaagattactaaaaatgggggaaaagacttctaatctttttttcataatatctttgacacatattacagaagaaataaatttcttacttttaatttaatatga

SEQ ID NO: 54 - DNA, 2724 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 55 - DNA, 3572 bp, Homo sapiens
acctgcacttctgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcattcggtaagaaaaagagatctacagacttcaacacatgtagaaacactactaactttttcagctttgaaaaggcattttaaattatacctgacatcaagtactgaacgtttttcacaaaatttcaaggtcgtggtggtggatggtaaaaacgaaagcgagtacactgtaaaatggcaggacttcttcactggacacgtggttggtgagcctgactctagggttctagcccacataagagatgatgatgttataatcagaatcaacacagatggggccgaatataacatagagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaagagcttgttcatcgagtgaaaagaagagctgacccagatcccatgaagaacacgtgtaaattattggtggtagcagatcatcgcttctacagatacatgggcagaggggaagagagtacaactacaaattacttaatagagctaattgacagagttgatgacatctatcggaacacttcatgggataatgcaggttttaaaggctatggaatacagatagagcagattcgcattctcaagtctccacaagaggtaaaacctggtgaaaagcactacaacatggcaaaaagttacccaaatgaagaaaaggatgcttgggatgtgaagatgttgctagagcaatttagctttgatatagctgaggaagcatctaaagtttgcttggcacaccttttcacataccaagattttgatatgggaactcttggattagcttatgttggctctcccagagcaaacagccatggaggtgtttgtccaaaggcttattatagcccagttgggaagaaaaatatctatttgaatagtggtttgacgagcacaaagaattatggtaaaaccatccttacaaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcagtgacaggaacagtccttgctgtaaaaactgtcagtttgagactgcccagaagaagtgccaggaggcgattaatgctacttgcaaaggcgtgtcctactgcacaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatgaaactgacaactcctgcaaggtgtgctgcagggacctttctggccgctgtgtgccctatgtcgatgctgaacaaaagaacttatttttgaggaaaggaaagccctgtacagtaggattttgtgacatgaatggcaaatgtgagaaacgagtacaggatgtaattgaacgattttgggatttcattgaccagctgagcatcaatacttttggaaagtttttagcagacaacatcgttgggtctgtcctggttttctccttgatattttggattcctttcagcattcttgtccattgtgtggataagaaattggataaacagtatgaatctctgtctctgtttcaccccagtaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagttttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaa

SEQ ID NO: 56 - DNA, 3008 bp, Homo sapiens
taattatgggtctgtaaccaccctggactgggtgctcctcactgacggacttgtctgaacctctctttgtctccagcgcccagcactgggcctggcaaaacctgagacgcccggtacatgttggccaaatgaatgaaccagattcagaccggcaggggcgctgtggtttaggaggggcctggggtttctcccaggaggtttttgggcttgcgctggagggctctggactcccgtttgcgccagtggcctgcatcctggtcctgtcttcctcatgtttgaatttctttgctttcctagtctggggagcagggaggagccctgtgccctgtcccaggatccatgggtaggaacaccatggacagggagagcaaacggggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaaaaaaaaaaaaaaaaaaaaa

SEQ ID NO: 57 - DNA, 5270 bp, Homo sapiens
aaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgttttagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagcggagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcagaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacgaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattctaaaacagaggtctgttttctttcctagtaagatatatttttatagaactagactacaatttaatttctggttgagaaaagccttctatttaagaaatttacaaagctatatgtctcaagattcacccttaaatttacttaaggaaaaaaataattgacactagtaagtttttttatgtcaatcagcaaactgaaaaaaaaaaaagggtttcaaagtgcaaaaacaaaatctgatgttcataatatatttaaatatttaccaaaaatttgagaacacagggctgggcgcagtggctcacacctataatcccagtacattggtaggcaaggtgggcagatcacctgaggtcaggagttcaagaccagcctggacaacatggtgaaaccctgtctctactaaataatacaaaaattagccaggcgtgctggcgggcacctgtaatcccagctactcgggaggctgaggcagggagaattgcttgcaccagggaggtagaggttgcagtgagccaagatcgcaccactgcactccagccggggcaacagagcaagactccatctcaaaaaaaaaaaaaaaaaaagaaagaaaagaaaatttgagaacacagctttatactcgggactacaaaaccataaactcctggagttttaactccttttgaaattttcatagtacaattaatactaatgaacatttgtgtaaagctttataatttaaaggcaatttctcatatattcttttctgaatcatttgcaaggaagttcagagtccagtctgtaactagcatctactatatgtctgtcttcaccttacagtgttctaccattattttttctttattccatttcaaaatctaatttattttaccccaacttctccccaccacttgacgtagttttagaacacacaggtgttgctacatatttggagtcaatgatggactctggcaaagtcaaggctctgttttatttccaccaaggtgcacttttccaacaactatttaactagttaagaacctccctatcttagaactgtatctactttatatttaagaaggttttatgaattcaacaacggtatcatggccttgtatcaagttgaaaaacaactgaaaataagaaaatttcacagcctcgaaagacaacaacaagtttctaggatatctcaatgacaagagtgatggatacttaggtagggaaacgctaatgcaggaaaaactggcaacaacacaatttatatcaattctctttgtaggcaggtgataaaaaattcaaggacaaatctcattatgtcattgtgcatcatatataatctcttatgagcgagaatggggggaatttgtgtttttactttacacttcaattccttacacggtatttcaaacaaacagttttgctgagaggagcttttgtctctccttaagaaaatgtttataaagctgaaaggaaatcaaacagtaatcttaaaaatgaaaacaaaacaacccaacaacctagataactacagtgatcagggagcacagttcaactccttgttatgttttagtcatatggcctactcaaacagctaaataacaacaccagtggcagataaaaatcaccatttatctttcagctattaatcttttgaatgaataaactgtgacaaacaaattaacatttttgaacatgaaaggcaacttctgcacaatcctgtatccaagcaaactttaaattatccacttaattattacttaatcttaaaaaaaattagaacccagaacttttcaatgaagcatttgaaagttgaagtggaatttaggaaagccataaaaatataaatactgttatcacagcaccagcaagccataatctttatacctatcagttctatttctattaacagtaaaaacattaagcaagatataagactacctgcccaagaattcagtcttttttcatttttgtttttctcagttctgaggatgttaatcgtcaaattttctttggactgcattcctcactactttttgcacaatggtctcacgttctcacatttgttctcgcgaataaattgataaaaggtgttaagttctgtgaatgtctttttaattatgggcataattgtgcttgactggataaaaacttaagtccacccttatgtttataataatttcttgagaacagcaaactgcatttaccatcgtaaaacaacatctgacttacgggagctgcagggaagtggtgagacagttcgaacggctcctcagaaatccagtgacccaattctaaagaccatagcacctgcaagtgacacaacaagcagatttattatacatttattagccttagcaggcaataaaccaagaatcactttgaagacacagcaaaaagtgatacactccgcagatctgaaatagatgtgttctcagacaacaaagtcccttcagaatcttcatgttgcataaatgttatgaatattaataaaaagttgattgagaaaaa

SEQ ID NO: 58 - DNA, 6492 bp, Homo sapiens
tttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 59 - DNA, 2575 bp, Homo sapiens
ggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaaaaaaaaaaaaaaa

SEQ ID NO: 60 - DNA, 4088 bp, Homo sapiens
gcggtgagtgctgctccttccgggctcgggcggcgtggggcgggtggggacgcgagggcccgcgggggcccacttccctgatgtggcggcgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccactcttctggcccttggactttgaccaagatgttttctcgcagtttttgcaaggttttaaacttagccctcggcgttcttttaatgtaatacattgaaacgaagatatttcggtggcggcgatatttcatatttcatagttgccactgcgctctgtcattccagtagtcgtctgttgtgtattgtgagaagcaactctgggaaattattggatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaagaaaaaaaaaaaaaaaa

SEQ ID NO: 61 - DNA, 2724 bp, Homo sapiens
cccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctaaaaaaaaaaaaaaaaaaaaaaaaa

SEQ ID NO: 62 - DNA, 1319 bp, Homo sapiens
gctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtccacaggtcaaggatgccaaagagagagggacagcaagtctggcaggatttcctgtatgactcccggctgaacaagggcaagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 63 - DNA, 4304 bp, Homo sapiens
cacacggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaa

SEQ ID NO: 64 - DNA, 6531 bp, Homo sapiens
gcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccgactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgtttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatgtagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattaaaaaaaaaa

SEQ ID NO: 65 - DNA, 4815 bp, Homo sapiens
agtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgtacaagggtcaggtgcctgagaacgaggctaacgtcgtaatcaccacactgaaagtgactgatgctgatgcccccaataccccagcgtgggaggctgtatacaccatattgaatgatgatggtggacaatttgtcgtcaccacaaatccagtgaacaacgatggcattttgaaaacagcaaagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccat

SEQ ID NO: 66 - DNA, 4134 bp, Homo sapiens
aacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccagggccaaacaacccacctgcactgcatggttcccccagcaagaacatcccagtgagaatggcccacagatgcctgggcgtgacccacctgcagcttcaaccatgcaggtgctgctgctaacatctgcagaagatttggactgcactcctggatttcagcagaaagtgttccatatcaatcagccagctgaattcattgaggaccagtcaattctaaacttgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggatatatttaaatttgcaagaacttctcctgtcccaagacaaaagaggtccattgtggtatctcccattttaattccagagaatcagagacagcctttcccaagagatgttggcaaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaactatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagagactctggaaaatcccaagtatgaactgatcatcgaggctcaagatatggctggactggatgttggattaacaggcacggccacagccacgatcatgatcgatgacaaaaatgatcactcaccaaaattcaccaagaaagagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaaccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacaatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaaaaaaaaa

SEQ ID NO: 67 - DNA, 2284 bp, Homo sapiens
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctggggatgtccgtcagaacccatgcggcagcaaggcctgccgccgcctcttcggcccagtggacagcgagcagctgagccgcgactgtgatgcgctaatggcgggctgcatccaggaggcccgtgagcgatggaacttcgactttgtcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctacccttcttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagacattttaagatggtggcagtagaggctatggacagggcatgccacgtgggctcatatggggctgggagtagttgtctttcctggcactaacgttgagcccctggaggcactgaagtgcttagtgtacttggagtattggggtctgaccccaaacaccttccagctcctgtaacatactggcctggactgttttctctcggctccccatgtgtcctggttcccgtttctccacctagactgtaaacctctcgagggcagggaccacaccctgtactgttctgtgtctttcacagctcctcccacaatgctgaatatacagcaggtgctcaataaatgattcttagtgactttacttgtaaaaaaaaaaaaaaaaa

SEQ ID NO: 68 - DNA, 2413 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctatt

SEQ ID NO: 69 - DNA, 1464 bp, Homo sapiens
cgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaaaaaaaaaaaa

SEQ ID NO: 70 - DNA, 11061 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgggtgcgccttcccggcgtctaggggagcgaaggctgaggtggcagcggcaggagagtccggccgcgacaggacgagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctataggatggtcatatcagctttataggagagtagctgtgtccctgaattctccctgacactgcatgctcttatatttcctcaagttttgacaatttgataggtgaaaagtggtatctgactgttcagatctggaaggctttgttatataaacatttttttaatgtttattggcaagaatacttttctaagagaaacatcagtgagctggtttccatttaagctgaatgaagccacaatgtacctcaagtataagattaactggcctttttcagttgcactctaattacaatttagaatgatgtttctgagccacctgtcaaatgcattctgggctgtacctctgcgtaccccaggaataaatctcatggccttctttacctggcctccttagtggtggcccagcaggaagcgggggttagagcaggagccactcagccttccaagatagatactccatgggccggtggtattactggccttttgagcccatccccatttgcatagatgatccacgtgggttatcatctggctggtatgttcccagagtgaaactcagcagccccttgagggaggggatggtggccatcaggccagagtattgcaagttagtttggatcatttgctaagcagcttgtggtgccttcagaaaggaacagtttcaaagaactttcacatctgttggctcatttcgccctaatgacagtcttctctttgatatttgcatggcattaaattttgcctttcttgttttctccagaaaacgcccactcctggatcttcacattgaactcaatggctacatgtatgattggaacagcagagtttctgccaaggagaaatattatgtctggctgcagcacactctgagaaagaaacttatcctctcctacacataagaaaccaaaaggctgggcgtagtggctcacacctgtaatcccagcactttgggaggccaaggagggcagatcacttcaggtcaggagttcgagaccagcctggccaacatggtaaacgctgtccctagtaaaaatacaaaaattagctgggtgtgggtgtgggtacctgtattcccagttacttgggaggctgaggtgggaggatcttttgaacccaggagttcagggtcatagcatgctgtgattgtgcctacgaatagccactgcataccaacctgggcaatatagcaagatcccatctctttaaaaaaaaaaaaaaaggacaggaactatcttactcaatgtattagtcatgtttctctagagggacagaactaataggatacatgtatataaaaaggggagtttattaaggagtattgactcacatgatcacagggttaggtcccacaataggtcatctgcaagcaaggaagccaattcaagtcccaaagctgaagaacttggagtccaatgtttgagggcaggaagcattcagcatgagagaaagatggaggccagaagactacaccagtctagtctttccatgttttgcctgcttttattctggcagtgctggcagctgattagatggtgcccacccagattgaggatggtctgcctttcccagtccactgactcaaatgttaaatctcctttggcagcaccctcacagatgtacccgggaacactttgcatccttctattcaatcaagttgatactcagtattaaccatcacagtccatttgggcaactataccaaattaccatagaccaggtgacttaaacagcagttatttctcacagttccggaggctgggaaatccaacatctaagtggtagcatatctggtgtctggtaaggcatgcttccagatcttaccagatgtcagtcttttgatgttctcacatggcagaaaaagaggatgcaaactctcaagtatatctttaagggcacaaattccattcatgagggctctaccctcatcacctaattacctcccaaaggccccaccttctgatactgtcactttggggatactgtctcccctttgaattctggggggaatacaaacattcagtttgtaacaatagccttatgatttagaggttacttgttcattcacctagacctcaaattgcattttacagctagtcaagtatatctttctctgatttgatagtgtgacctaaaaggggaccattgtttgaaatatcattagagttgcttattattattattattattattattattattattattattattattgagacagagtttcattctgctgcccaggctggagtgcagtggcatcatcttggctcattgcaacctctgccttctgggttcaagcgattctcctgcctcagcctcccgagtagctgggattacaggctcctgccaccacacccggctaatttttgtatttttagtggagacagggtttccaccatgttggccagcgtggtcttgaactcctgacctcaggtgattcaccagcctcggcctcccaaagtgctgggattacaggtgtgagccactgcacctggcctattattatttttaaattttttttttttaattgatcattcttgggtgtttctcacagagggtgatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcactgcccttaatccatttaaccctgagtggacacagcacatgtttcagagagcacagggttgggggtaaggtcatagatcaacagcatcctaaggcagaagaatttttcttagtacagaacaaaatgaagtctcccatgtctacttctttctacacagacacagcaacaatctgatttctctatcttttccccacctttcccccttttctattccacaaaaccgccatcgtcatcatggcctgttctcaatgagctgttgggtacacctcccagacggggtggcggctgggcagaggggctcctcacttcccagatggggcggccaggcggacgcgccccccacctccctcccggacgggatagctggccgggcgggggctgaccccccacctccctccccgacggggcggctggccgggcgggggctgacccccacgcctccctcccggacggggcggctgccaggcggaggggctcctcacttctcagacggggtggctgctgggcggagacgctcctcacttcccagacagggtggctgtcgggcggaggggctcctcacttctcagacggggcagctgcgggcggaggggctcctcacttctcagacggggtggccgggcagagaagctcctcacatcccagacgggggggcggggcagaggcgctccccacatctcagacgatgggcggccgggcagagacgctcctcacttcatcccagacggggtggcggccgggcagaagctgtaatctcggcaccctggggggccaaggcaggcggctgggaggcggaggccgtagccagctgagatcacaccactgcactccagcctgggcaacattgagcactgagtggacgagactctgcccgcaatcccggcacctcgggaggccgaggctggcagatcactcgcagtcaggagctggagaccagcccggccaacacagtgaaaccctgtctccaccaaaaaaatacgaaaaccagtcaggcgtggcggcgcccgcaatggcaggcacgcggcaggccgaggcgggagaatcaggcagggaggctgcagtgagccgagatggcagcagtacagtccagcttcggctcggcatcagagggagaccgtggggagagggagaagagagggagggggagagggctatttttaaaattttttaaaattgctgaacaggggtacctctgggcagtgtgtcagaataccactttttaaatattttatgatttatttatttttctatttcttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggatcccctgagcccagagaggtcaaggttgtgatgagctgtgatcacaccactgcacttcagcatgggagacagagtgagaccctgtttcagaaaaaataaataaataaaaccaccagcaccacaaacaacaacaaaaagttattttgtacttgttttgagcacaggactcctgagggtatctttgcatttaatattacataggggtgccagtgggaagtaatgtgtatgcttggcctcatgagctaaaaccctgtgttaattatgacagaaggaaagtgtgtgagagagatcttaactacctagcagctctagctgccatcttgaaccatgaagatacgggccacacgtaggggtagctgggtagtgagcagcaagaagccttgttggatgagggcacgaaggagcagaatcactggaatcactgtgtcagccctaattacctacctctggacttttatgtgaggggaaaaaaaattgacagtttatatttatctcaacctagttaacccaagtgatgcattgttatgagattaaaatgtttggaggccgggtgcggtggctcacgcctataatcccagccctttgggaggccaaggcgggcggatcacgaggtcaggagatcaagaccatcctggctaacatgtaaaaccccgtctctactaaaaatacaaaaaattagccaggcgttgtggcggtcgcctgtagtccctgctatttgggaggccgaggcaagagaacggcatgaacctgggaggtggagcttgcagcgagctgagatcttgccactgcactccagcctgggcgacagtgcgagactctgtctcaaaaataaataaataaataaataataaataaaatgtttggaatgttggcttcatccctgggatgcaaggctggttcaacatacgcaaatcaagaaacataattcatcacataaacagaactaaagacaaaaaccacatgattatctcaatagatacagaaaaggccttcaataaaattcaacgttgcttcatgttaaaaactctcaataaactaggtattgatggaaaatatctcaaaataataaccatttatgacaaacccacagccattatcatactgaatgggcaaaagctggaagcattccccttgaaaactggcacaagacagggatgccgtctcaccactcctatttaacatagtattggaagttctggccaagaaaatcaggcaagagaaacaaataaggggtattcaaataggaaaagaggaagtaaaactgtgtttgcagatgacatgatactatatctagaaaaccccattatctccacccaaaagttccttaagctgataagcaacttcagcaaagtctcaggatacaaaatcaatgtgcagaaatcacaagcattctatacaccaacaatacacaagcagagagccaaatcatgaatgaactcccattcacagttgctagaaagagaataaaatacctaggaatacagctaataagatgtgaaggatctcttcaaggagaactacaaaccactgctcaaggaaataagagaggacacaaatgaaaaaacattccattctcgtggataggaagaatcaatatcatgaaaatggccatactacccaaagtaatttataggttcattgctattcccattaaactactattgacattcttcacagaattagaaaaaaactactttaaaattcaaatggaaccaaaaaagagcccgtataaccaagacaacaataagcaaaaagaacaaagctggaagcatcacactacccaacttcaaagtatactgcaaggctacagtagccaaaatggcatggtactggtacaaaaacagacacatagaccaatggaacagaatagagaccagagaaagaagaccacacatctacagccatctgatcatcgacaaacctgacaaaaacaagcaatggggaaaagattccctatttaataaatggtgctgggaaaactggctagccatatgcagaaaattgaaactgaccccttccttacaccttatacaaaaattaactcaagattaaagacttaatgtaaaacctaaaactataaaaaccctagaagaaaatctatttaataccattcaagacataggcacaagcaaaggtttcatgacaaaaacatcaaaagcaattgcaacaaaagcaaaaattacaaatgggatctaattaaactaaagagctcctgcacagcaaaagaaactatcattagagtgaacaggcaacctacagaatgggagaacatttttgcaatctatccatctgacaaaggtctaatatccagaacctacaaggaacttaaaacaaatttacaaggaaaaaaacaaccccatcaaaaagtggacaaaggacatgaacagacacttctcaaaagaagacatttatgtggccaacaaacatataaaaaaaagctcaaccttactgatcattagagaaatgcaaaggagaaccacaatgagataccatctcatgccggtcagaatggtgattattaaaaagtcaaaaaacaacagatgctggcgaggctgtggagaagtaggaacacttttacattgttggtgggaatgtaaattagttcaaccgttgtggaagtgtgtgtggctattcctcaaagatctagaactagaaatactatttgtcccagcaatcccattactgggtatatacccaaaggaatataaaccattttattataaagatacatgcacatttttgttcattgcagcactcttcacaatagcaaagacacaatagcaaatgcccatcaaagatagactggataaagaaaatgtggtacatatacaccatggaatactgtgcagtgcagccattacagcttttggtgatacagtgaatcagatttttcattaattcttttaattggttattactgaacgtgaaaaagtaatgtttgtattgaaatcttgagtctggccatgtttctattttaaattcataaagaattctaacaagaggaattccaagaatgtcataaatggatgtttctccatggatgaaggaactgttttattcacttgctgataattcagcctaatccagtttgacatcatatagataagtagttgaattatggatttaaaatacatatcattttctaactccaaaggtaatacttatttaaatggttttgaaaatatagaaaggcacaatttctttttaaatctgttattctccaccaccactcaatctgtctatcatctatctctccattcattcttccatttgtttatatctgttaatctttgtatgtgttcatgtatagcttttacatgattggaatcataatgcatattccattttgaagtctgcttttttttacacaaaaatatgttgtgaatattttcctatattatgaaatatcattagctgagcttttagaattgactgcatgttttggtaccatttagatatagtttaagatacttagaagttatgtggctttgccactatggatgaatcttatttactcaatattaattacttacaaataacctcacctaaacactactcagccataaaaaggaatgaattaatgacattcacagcaacctggagactattactctaaaggaagtaactgaggaatggaaaaccaaacattgtatgttctcactcataagtgggagataagctatgaggatgcaaaggcataagaaggatacaatggactttggggacttaggggaaagggtgggaggggggtgaaggataaaagaatacaaattgggttcagtgtatactgctcaggtgatgggtgcaccagaatctcacaagtaaccacttaattacttacgcatgtaaccagataccacctgttccccaaacacctatggaaataattttgtttttttttttaaaaaaggaatgagatcatgtcctttgcagggacatggatgaagctggaagccattatcctcagcaaactaacagaggagcaggaaaccaaacaccacatgttctcacttgtaagcggaagctgaacaatgagaacacacggacacagggatgagatcaacacacactggggcctgatgcaggggccgtagcggggagagcatcaggataactagctaatgcatgtggggcttaatacctaggtgataggttgataggtgcagcaaaccaccatgggacacgtttacctatgtaacaaacccgcacatcctgcacttgtatccagaacttaaaatattttaaaaatctttagagaatacaaaaaaaaaaaaaaagattcttcaatgcatacacaataaaattgcagttcagtcaaacattggaagtctttctctgactgtctagttggtatcttcattttcagcttcttcaagatcccactccaaacactgttagctcagccaaattgaacagctcatatctcctacctctggatctttggttctggtgattgtatatttctggaccatctggaaccccagcatatcaccctaccccacatctccacatccccaaaatataaccatacttcaagggcagttcaaataccatctccttctatcctccatgaagtcagttatctcttccattggaattatcgccccctctcctgaacagtactatttcgtgtgaatctcctccaagccttcttttcattttatatctcatgctgtaattcttggaaagtatgctgtagctcaagtgcagaattctcatcagttttatctttatatctctcctaaacactttacctgatgaagagcctggcatacacataaatatatattgaatgaatcagtgatggattgaaaagagaaatgatggatctcctaaattttaacttttataaaatattttgatacattcatgaccttactttagcaagcaatgaacgtgatgtaaactattgttgatatagtttttatattggaagtgtaagtagtttgtggcatgggattgtgacatatcctaggtttcctcatcttctttttattgaaatgtaattcacaagccataaaatttgcccctttaaagtaaatgatgcagtggattttagtatatttacagagttgtgcaatcatcaccactatctaattccagaacatttccatctacctagaaactccataccagtgagctgccactctaatcctcctcttcccccagcctctagaaacaataatccattttctgtctctatgatttgcctgttctagatattttataaaaataaacatgtggcctttcgtgtctgacttccttcacttaaaaaaaaaaaaaaaaaa

SEQ ID NO: 71 - DNA, 3720 bp, Homo sapiens
aggatacagcggcttctgcgcgacttataagagctccttgtgcggcgccattttaagcctctcggtctgtggcagcagcgttggcccggccccgggagcggagagcgaggggaggcggagacggaggaaggtctgaggagcagcttcagtccccgccgagccgccaccgcaggtcgaggacggtcggactcccgcggcgggaggagcctgttcccctgagggtatttgaagtataccatacaactgttttgaaaatccagcgtggacaatggctactcaagctgatttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtgggaacagggattttctcagtccttcactcaagaacaagtagctgatattgatggacagtatgcaatgactcgagctcagagggtacgagctgctatgttccctgagacattagatgagggcatgcagatcccatctacacagtttgatgctgctcatcccactaatgtccagcgtttggctgaaccatcacagatgctgaaacatgcagttgtaaacttgattaactatcaagatgatgcagaacttgccacacgtgcaatccctgaactgacaaaactgctaaatgacgaggaccaggtggtggttaataaggctgcagttatggtccatcagctttctaaaaaggaagcttccagacacgctatcatgcgttctcctcagatggtgtctgctattgtacgtaccatgcagaatacaaatgatgtagaaacagctcgttgtaccgctgggaccttgcataacctttcccatcatcgtgagggcttactggccatctttaagtctggaggcattcctgccctggtgaaaatgcttggttcaccagtggattctgtgttgttttatgccattacaactctccacaaccttttattacatcaagaaggagctaaaatggcagtgcgtttagctggtgggctgcagaaaatggttgccttgctcaacaaaacaaatgttaaattcttggctattacgacagactgccttcaaattttagcttatggcaaccaagaaagcaagctcatcatactggctagtggtggaccccaagctttagtaaatataatgaggacctatacttacgaaaaactactgtggaccacaagcagagtgctgaaggtgctatctgtctgctctagtaataagccggctattgtagaagctggtggaatgcaagctttaggacttcacctgacagatccaagtcaacgtcttgttcagaactgtctttggactctcaggaatctttcagatgctgcaactaaacaggaagggatggaaggtctccttgggactcttgttcagcttctgggttcagatgatataaatgtggtcacctgtgcagctggaattctttctaacctcacttgcaataattataagaacaagatgatggtctgccaagtgggtggtatagaggctcttgtgcgtactgtccttcgggctggtgacagggaagacatcactgagcctgccatctgtgctcttcgtcatctgaccagccgacaccaagaagcagagatggcccagaatgcagttcgccttcactatggactaccagttgtggttaagctcttacacccaccatcccactggcctctgataaaggctactgttggattgattcgaaatcttgccctttgtcccgcaaatcatgcacctttgcgtgagcagggtgccattccacgactagttcagttgcttgttcgtgcacatcaggatacccagcgccgtacgtccatgggtgggacacagcagcaatttgtggagggggtccgcatggaagaaatagttgaaggttgtaccggagcccttcacatcctagctcgggatgttcacaaccgaattgttatcagaggactaaataccattccattgtttgtgcagctgctttattctcccattgaaaacatccaaagagtagctgcaggggtcctctgtgaacttgctcaggacaaggaagctgcagaagctattgaagctgagggagccacagctcctctgacagagttacttcactctaggaatgaaggtgtggcgacatatgcagctgctgttttgttccgaatgtctgaggacaagccacaagattacaagaaacggctttcagttgagctgaccagctctctcttcagaacagagccaatggcttggaatgagactgctgatcttggacttgatattggtgcccagggagaaccccttggatatcgccaggatgatcctagctatcgttcttttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggtaagaagttttaaaaagccagtttgggtaaaatacttttactctgcctacagaacttcagaaagacttggttggtagggtgggagtggtttaggctatttgtaaatctgccacaaaaacaggtatatactttgaaaggagatgtcttggaacattggaatgttctcagatttctggttgttatgtgatcatgtgtggaagttattaactttaatgttttttgccacagcttttgcaacttaatactcaaatgagtaacatttgctgttttaaacattaatagcagcctttctctctttatacagctgtattgtctgaacttgcattgtgattggcctgtagagttgctgagagggctcgaggggtgggctggtatctcagaaagtgcctgacacactaaccaagctgagtttcctatgggaacaattgaagtaaactttttgttctggtcctttttggtcgaggagtaacaatacaaatggattttgggagtgactcaagaagtgaagaatgcacaagaatggatcacaagatggaatttatcaaaccctagccttgcttgttaaatttttttttttttttttttaagaatatctgtaatggtactgactttgcttgctttgaagtagctctttttttttttttttttttttttttgcagtaactgttttttaagtctctcgtagtgttaagttatagtgaatactgctacagcaatttctaatttttaagaattgagtaatggtgtagaacactaattcataatcactctaattaattgtaatctgaataaagtgtaacaattgtgtagcctttttgtataaaatagacaaatagaaaatggtccaattagtttcctttttaatatgcttaaaataagcaggtggatctatttcatgtttttgatcaaaaactatttgggatatgtatgggtagggtaaatcagtaagaggtgttatttggaaccttgttttggacagtttaccagttgccttttatcccaaagttgttgtaacctgctgtgatacgatgcttcaagagaaaatgcggttataaaaaatggttcagaattaaacttttaattcattcgattg

SEQ ID NO: 72 - DNA, 1912 bp, Homo sapiens
ttttttttcttccctctagtgggcggggcagaggagttagccaagatgtgactttgaaaccctcagcgtctcagtgcccttttgttctaaacaaagaattttgtaattggttctaccaaagaaggatataatgaagtcactatgggaaaagatggggaggagagttgtaggattctacattaattctcttgtgcccttagcccactacttcagaatttcctgaagaaagcaagcctgaattggttttttaaattgctttaaaaattttttttaactgggttaatgcttgctgaattggaagtgaatgtccattcctttgcctcttttgcagatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttaaaaaaaaaaaaaaaaaa

SEQ ID NO: 73 - DNA, 2722 bp, Homo sapiens
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtttgggccgggttttgggactctgttgggaacatttcggggcgggagaggccaaggttgctggggaaatgcccattctccacttcccttctccctgtccgtgcccgatttgatttgagcctcataactcgaagaaaggtcagcttcctcgctgttttggtcctaactcaaaagcagatccagtaaaggtttttgttgtaaaaaaaaaaaaaaaaaaaaaaa

SEQ ID NO: 74 - DNA, 5600 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctgagcagaaactttgcaaattgaggaaaggaaactgcagcagcactgtgtgtgggcaagacctccagtcacacttgtgcatgtgtgcagagggatacgccctaagtcgagaccggaagtactgtgaagatgttaatgaatgtgctttttggaatcatggctgtactcttgggtgtaaaaacacccctggatcctattactgcacgtgccctgtaggatttgttctgcttcctgatgggaaacgatgtcatcaacttgtttcctgtccacgcaatgtgtctgaatgcagccatgactgtgttctgacatcagaaggtcccttatgtttctgtcctgaaggctcagtgcttgagagagatgggaaaacatgtagcggttgttcctcacccgataatggtggatgtagccagctctgcgttcctcttagcccagtatcctgggaatgtgattgctttcctgggtatgacctacaactggatgaaaaaagctgtgcagcttcaggaccacaaccatttttgctgtttgccaattctcaagatattcgacacatgcattttgatggaacagactatggaactctgctcagccagcagatgggaatggtttatgccctagatcatgaccctgtggaaaataagatatactttgcccatacagccctgaagtggatagagagagctaatatggatggttcccagcgagaaaggcttattgaggaaggagtagatgtgccagaaggtcttgctgtggactggattggccgtagattctattggacagacagagggaaatctctgattggaaggagtgatttaaatgggaaacgttccaaaataatcactaaggagaacatctctcaaccacgaggaattgctgttcatccaatggccaagagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtggtgaagttgatctaaagaaccaagtaacaccattggacatcttgtccaagactagagtgtcagaagataacattacagaatctcaacacatgctagtggctgaaatcatggtgtcagatcaagatgactgtgctcctgtgggatgcagcatgtatgctcggtgtatttcagagggagaggatgccacatgtcagtgtttgaaaggatttgctggggatggaaaactatgttctgatatagatgaatgtgagatgggtgtcccagtgtgcccccctgcctcctccaagtgcatcaacaccgaaggtggttatgtctgccggtgctcagaaggctaccaaggagatgggattcactgtcttgatattgatgagtgccaactgggggagcacagctgtggagagaatgccagctgcacaaatacagagggaggctatacctgcatgtgtgctggacgcctgtctgaaccaggactgatttgccctgactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaactgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggactcagaagctgctatcgaaaaacccaaagaatccttatgaggagtcgagcagagatgtgaggagtcgcaggcctgctgacactgaggatgggatgtcctcttgccctcaaccttggtttgtggttataaaagaacaccaagacctcaagaatgggggtcaaccagtggctggtgaggatggccaggcagcagatgggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagtaaaaaaaaaaaaaaaaaa

SEQ ID NO: 75 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 76 - DNA, 8761 bp, Homo sapiens
gccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatgggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaagtggcacactgtgcatcttctcgacaaatcatttcacactggaagaattgtacaagacatgattgtcctgtgtgtctccccctcaaaaatgctggtgataagagaaatcaacagccaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtgctagtcctatgggagtaaatggaggtgtaggagttcaaacgccgagtcttctttctgactcaatgttgcattcagccataaattctcaaaacccaatgatgagtgaaaatgccagtgtgccctccctgggtcctatgccaacagcagctcaaccatccactactggaattcggaaacagtggcacgaagatattactcaggatcttcgaaatcatcttgttcacaaactcgtccaagccatatttcctacgccggatcctgctgctttaaaagacagacggatggaaaacctagttgcatatgctcggaaagttgaaggggacatgtatgaatctgcaaacaatcgagcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctaatggccctctacctgacccaagtatgatccgtggcagtgtgccaaaccagatgatgcctcgaataactccacaatctggtttgaatcaatttggccagatgagcatggcccagccccctattgtaccccggcaaacccctcctcttcagcaccatggacagttggctcaacctggagctctcaacccgcctatgggctatgggcctcgtatgcaacagccttccaaccagggccagttccttcctcagactcagttcccatcacagggaatgaatgtaacaaatatccctttggctccgtccagcggtcaagctccagtgtctcaagcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccactttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagattttcaaaccagaagaactacgacaggcactgatgccaactttggaggcactttaccgtcaggatccagaatcccttccctttcgtcaacctgtggaccctcagcttttaggaatccctgattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaagttggagttctctccacagacactgtgttgctacggcaaacagttgtgcacaatacctcgtgatgccacttattacagttaccagaacaggtatcatttctgtgagaagtgtttcaatgagatccaaggggagagcgtttctttgggggatgacccttcccagcctcaaactacaataaataaagaacaattttccaagagaaaaaatgacacactggatcctgaactgtttgttgaatgtacagagtgcggaagaaagatgcatcagatctgtgtccttcaccatgagatcatctggcctgctggattcgtctgtgatggctgtttaaagaaaagtgcacgaactaggaaagaaaataagttttctgctaaaaggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggagagtatacatatcttacctcgatagtgttcatttcttccgtcctaaatgcttgaggactgcagtctatcatgaaatcctaattggatatttagaatatgtcaagaaattaggttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacagaca

SEQ ID NO: 77 - DNA, 1855 bp, Homo sapiens
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaattttctattcctaa

SEQ ID NO: 78 - DNA, 7123 bp, Homo sapiens
atcgaggtccgcgggaggctcggagcgcgccaggcggacactcctctcggctcctccccggcagcggcggcggctcggagcgggctccggggctcgggtgcagcggccagcgggcgcctggcggcgaggattacccggggaagtggttgtctcctggctggagccgcgagacgggcgctcagggcgcggggccggcggcggcgaacgagaggacggactctggcggccgggtcgttggccgcggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctctttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcctgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatacgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgcttttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccagggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagaactttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagaggagttttctccatatcaaaacgagggctgatggaggaaaaaggtcaataaggtcaagggaaaaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttatgatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttcttcctcttctttacatacgcaaaccacctgtgacagctggcaattttataaatcaggtaactggaaggaggttaaacacagaaaaaagaagacctcagtcaattctctacttttttttttttttccaaatcagataatagcccagcaaatagtgataacaaataaaaccttagctattcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtatgtgtgtgtgtgtgtgtgtgtgtgtgtgtgtgtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataataaacttccaaaaacaca

SEQ ID NO: 79 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 80 - DNA, 986 bp, Homo sapiens
tgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctaaaaaaaaaaaaaaaaaaaaaaaaaaaaa

SEQ ID NO: 81 - DNA, 2820 bp, Homo sapiens
gggagttcagacctagatctttccagttaatcacacaacaaacttagctcatcgcaataaaaagcagctcagagccgactggctcttttaggcactgactccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttcaaaaaaaaaaaaaaaa

SEQ ID NO: 82 - DNA, 1251 bp, Homo sapiens
tgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcagggcagccgctctggctctagctccagctccgggaccctctgggaccccccgggacccatgtgacccagcggcccctcgcgctggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgaaaaaaaaaaaaaaaaaa

SEQ ID NO: 83 - DNA, 1660 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaa

SEQ ID NO: 84 - DNA, 2638 bp, Homo sapiens
agatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggcgggcttgggtcccgtggtgcgctgcgagccgtgcgacgcgcgtgcactggcccagtgcgcgcctccgcccgccgtgtgcgcggagctggtgcgcgagccgggctgcggctgctgcctgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctagtgccgtcagccgcctgcgcgcctacctgctgccagcgccgccagctccaggtgagccgcccgcgccaggaaatgctagtgagtcggaggaagaccgcagcgccggcagtgtggagagcccgtccgtctccagcacgcaccgggtgtctgatcccaagttccaccccctccattcaaagataatcatcatcaagaaagggcatgctaaagacagccagcgctacaaagttgactacgagtctcagagcacagatacccagaacttctcctccgagtccaagcgggagacagaatatggtccctgccgtagagaaatggaagacacactgaatcacctgaagttcctcaatgtgctgagtcccaggggtgtacacattcccaactgtgacaagaagggattttataagaaaaagcagtgtcgcccttccaaaggcaggaagcggggcttctgctggtgtgtggataagtatgggcagcctctcccaggctacaccaccaaggggaaggaggacgtgcactgctacagcatgcagagcaagtagacgcctgccgcaaggttaatgtggagctcaaatatgccttattttgcacaaaagactgccaaggacatgaccagcagctggctacagcctcgatttatatttctgtttgtggtgaactgattttttttaaaccaaagtttagaaagaggtttttgaaatgcctatggtttctttgaatggtaaacttgagcatcttttcactttccagtagtcagcaaagagcagtttgaattttcttgtcgcttcctatcaaaatattcagagactcgagcacagcacccagacttcatgcgcccgtggaatgctcaccacatgttggtcgaagcggccgaccactgactttgtgacttaggcggctgtgttgcctatgtagagaacacgcttcacccccactccccgtacagtgcgcacaggctttatcgagaataggaaaacctttaaaccccggtcatccggacatcccaacgcatgctcctggagctcacagccttctgtggtgtcatttctgaaacaagggcgtggatccctcaaccaagaagaatgtttatgtcttcaagtgacctgtactgcttggggactattggagaaaataaggtggagtcctacttgtttaaaaaatatgtatctaagaatgttctagggcactctgggaacctataaaggcaggtatttcgggccctcctcttcaggaatcttcctgaagacatggcccagtcgaaggcccaggatggcttttgctgcggccccgtggggtaggagggacagagagacagggagagtcagcctccacattcagaggcatcacaagtaatggcacaattcttcggatgactgcagaaaatagtgttttgtagttcaacaactcaagacgaagcttatttctgaggataagctctttaaaggcaaagctttattttcatctctcatcttttgtcctccttagcacaatgtaaaaaagaatagtaatatcagaacaggaaggaggaatggcttgctggggagcccatccaggacactgggagcacatagagattcacccatgtttgttgaacttagagtcattctcatgcttttctttataattcacacatatatgcagagaagatatgttcttgttaacattgtatacaacatagccccaaatatagtaagatctatactagataatcctagatgaaatgttagagatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcttttctttatttttttaactttttggggggaaaagtatttttgagaagtttgtcttgcaatgtatttataaatagtaaataaagtttttaccattaaaaaaatatctttccctttgttattgaccatctctgggctttgtatcactaattattttattttattatataataattattttattataataaaatcctgaaaggggaaaataaaaaaaa

SEQ ID NO: 85 - DNA, 8743 bp, Homo sapiens
ggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggctatgtgtcaccttccctaagactcttaccttatctcatattttttgagaacttccagtgttacattatttaactgaatgtaattggcccatttgccttggtgggtgctggcctattagtgattagttaacaaaacacagcgtacagagagcacagaaaagcttaatgacctgctactgaaacacctagccagcagtgaaaatgttaattcttttcttgtttggaaagtatacacgtcttggaattttttccacgtgaaaaacaaatggcaatgaatgcatttaaagatattgccgacagatttttaaatctttttaccaggaaacttcctaaaggttaaatgaattaatgcaaatatcaggctccctctgagtctgtgggagcctctatctctctatcaggaattcgcatccctactattgggaggagcaacattttatttctctgaacgcctaagctccctgggtgggagtggggactacaaggtaggggccagggttggagggcattgtagtggctgctgcctcctgatgaactgtttggggaccccagctctactcaaaagggagcggagataaatggaacccctcacactgctgaggcccgtgttactgttcattcagccaggtggcatgtacctcacagactgttgtgcagtgtccgttattgcagattttaatcatttgcatgctcatcaatttctaagataaatagggtctagagtcataagaatccattgttttcaaggaacttgcagaattacatcatttcctattagtagagagcactacccattttgaaaatctgatatgaaagttgttttttactcttgtaaaaaaagactttcttagtcaaactaacttttcatattttcaagcattctgattcatactcttgctagtggaagaagagagcaagctgccctgctcttttcctttgaggactgaaatagttaaagagaaatcaatgaacaaagtcactcccaaccattttcctgtaaagctggttattatttctcaaggaacctacactttgaatatgtgttaccgagatacctctacatgtggaattatcaacatgttttgaatgagagcagaaatgaacagactggaaaaatctatctcttggtttctatttctctgactttttgagtcgaaaagcataaaggtagaaattcttatttaagctgcttctagtggtgcctgagctggttttgatggtggcatcaaactaccgatttaaaactggaagttgctggtactcaaaccaaaagttcatactctggcgacacgaagggtttcctttgagcaacgtcagctgctgagtccttgtgttcagttcccattgaggagagttggcttttatccatttcaaagcatttgtaggccagccaagggctttcattattgaggcttctagtggcctctggttaacctagaagttagtgggtttttcttgatgacaccaacctctcacagcgtttttccttagagacttaagcagagttttaaaatcctcttttgcgaaaagaacaaatatgttttatgactttgatgatatcttcattctgggcaaaagaatggccctagaaccagctagaagtgaagagaatccattaatgatcaaccacctgagtcaataatgagaaatcagtactgatgttacatttgtggctatttcttgctgactttcaaaggtcaaggactcttgactaatccagtgactgcaaaaatggatctactaaaagtcatctagccagaagtagagatttttaacctttctttccctggcttttgtcttctagctatcatttaaatttgagacatttgaagtattaagaaacaatttttctgtatggtaagaaacagtattttacaatactgaagccctgttttattcaatcttgcatcttgaatacaatataccacaaagtcggaaactttatatttatttactgcaggtggttaaaaaaaggggggaaagggtttcaccatccactgacaacgagagccatgacaaatagtatccatgtgcagtcttccaactgctggtgacaatgaccccatatttggtctcatgctgcttttgcagagcactctgtaggttagtccatcacacaaggaggccctgaatccagacactgtgaattaagaccttggcggggagagatgtgacccttttggtaggaatgggaagaagaatgggtggaagccaatatgaaatttcttctttgcaatgacttgacaggggagttaatgttcctaggatgccatgaatgatgaatgttagttggaggtaatgctgtatatgtgtgtgtgtgtgtgtgtgtgtgtttgtgtgtgtgtatatatatgtgtgtgtgtatatatatgtgacatgtgtgtgtctttgtgtgtgtgtatatatatgtgacgtgtgtgtgggatgtgtgtgtgtatatatagatgaatatatacaaatatatagatatatacacacatatatagatatatatacacatatatagatatatatacacacatatatagatacacatatgtgtgtgtgtgtatatatatatatatatatatatagatgtataggcttgtgagaaacttgagaggaagaagcatgctcttctaggaatgtgaggaaatatgaccttgccaagactaaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatattggaggtgcttaaccctactcgaggaattaattatgaataaagagcttataattagctaacatgactagaaaacacatgacttaggtggagagttagctttcttttctagtttgtgtatgacttgccatttgtgacgtatacaccaaaagatctggtgttttagacttctgccattcacttggcatttaaatctctctttgcttatgctgttaacgagtatgccataggataggacaaattcagtaaacaggaaaacttgtccatatttgcatagacatttgtagggttttttttttctttttctttttagaacttcaccattggcttaagaatgtagttcccaaaacaattttttcttgcaaagtactttccttacacctcttggctacagggtgggccaaattaaacatatatgtattttcatttaatgtatgtgcagtttggtttatcatcttaagatggtggtgctgccccggtgctacttcatctgtgtacacaaagaccaatgcatggtctgtattgctaccaaaacatttactgtatatatgtttataacatgtattatgtatatatgtaatgggtgccaggccaggtatatattttttatttagaagtgtttcacttttccaagttttctttatagtgttatgcttattttcaattttttttttcctgattctgtctggtacttagaattgtagtgtcttcatcatcaattaaagaaaactgtctaaatgaattcatggatgtaaatattagtggtccttaatgtctttgattgctggacatgaaacaaactgccaattaaattttgcggagacaaaaaaaa

SEQ ID NO: 86 - DNA, 3879 bp, Homo sapiens
atcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 87 - DNA, 6055 bp, Homo sapiens
actgagtcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacacccccaactcctggacatcacatgagaggtgctgctcagattttcaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctctttttcattcatttaaaaagcatttatcatgccccctgctgcgggtctcaccatgggtttagaacaaagacgttcaagaaatggccccatcctcaaagaagtagcagtacctggggagctgacacttctgtaaaactagaagataaaccaggcaatgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttacgtgtctcctggccaagccccaggaaggaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttgaaggaatccctttgcaaggttgcattactgtacccatcatttctaaaatggaagagggggtggctgggcacagtggccgacacctaaaaacccagcactttggggggccaaggtgggaggatcgcttgagcccaggagttcaagaccagtctggccaacatggtcagattccatctcaaagaaaaaaggtaaaaataaaataaaatggagaagaaggaatcaga

SEQ ID NO: 88 - DNA, 4107 bp, Homo sapiens
gcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagggaaaaaaaaaaaaaaaaaa

SEQ ID NO: 89 - DNA, 6695 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtacttggtggaaagaacctctcaacattgtcagttttctattttgctttgccagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 90 - DNA, 3226 bp, Homo sapiens
aagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtggaatttgaaaaaaaaaaaaaaaaaa

SEQ ID NO: 91 - DNA, 4472 bp, Homo sapiens
ccgcagacgcctgggaactgcggccgcgggctcgcgctcctcgccaggccctgccgccgggctgccatccttgccctgccatgtctcgccggaagcctgcgtcgggcggcctcgctgcctccagctcagcccctgcgaggcaagcggttttgagccgattcttccagtctacgggaagcctgaaatccacctcctcctccacaggtgcagccgaccaggtggaccctggcgctgcagcggctgcagcggccgcagcggccgcagcgcccccagcgcccccagctcccgccttcccgccccagctgccgccgcacatagctacagaaattgacagaagaaagaagagaccattggaaaatgatgggcctgttaaaaagaaagtaaagaaagtccaacaaaaggaaggaggaagtgatctgggaatgtctggcaactctgagccaaagaaatgtctgaggaccaggaatgtttcaaagtctctggaaaaattgaaagaattctgctgcgattctgcccttcctcaaagtagagtccagacagaatctctgcaggagagatttgcagttctgccaaaatgtactgattttgatgatatcagtcttctacacgcaaagaatgcagtttcttctgaagattcgaaacgtcaaattaatcaaaaggacacaacactttttgatctcagtcagtttggatcatcaaatacaagtcatgaaaatttacagaaaactgcttccaaatcagctaacaaacggtccaaaagcatctatacgccgctagaattacaatacatagaaatgaagcagcagcacaaagatgcagttttgtgtgtggaatgtggatataagtatagattctttggggaagatgcagagattgcagcccgagagctcaatatttattgccatttagatcacaactttatgacagcaagtatacctactcacagactgtttgttcatgtacgccgcctggtggcaaaaggatataaggtgggagttgtgaagcaaactgaaactgcagcattaaaggccattggagacaacagaagttcactcttttcccggaaattgactgccctttatacaaaatctacacttattggagaagatgtgaatcccctaatcaagctggatgatgctgtaaatgttgatgagataatgactgatacttctaccagctatcttctgtgcatctctgaaaataaggaaaatgttagggacaaaaaaaagggcaacatttttattggcattgtgggagtgcagcctgccacaggcgaggttgtgtttgatagtttccaggactctgcttctcgttcagagctagaaacccggatgtcaagcctgcagccagtagagctgctgcttccttcggccttgtccgagcaaacagaggcgctcatccacagagccacatctgttagtgtgcaggatgacagaattcgagtcgaaaggatggataacatttattttgaatacagccatgctttccaggcagttacagagttttatgcaaaagatacagttgacatcaaaggttctcaaattatttctggcattgttaacttagagaagcctgtgatttgctctttggctgccatcataaaatacctcaaagaattcaacttggaaaagatgctctccaaacctgagaattttaaacagctatcaagtaaaatggaatttatgacaattaatggaacaacattaaggaatctggaaatcctacagaatcagactgatatgaaaaccaaaggaagtttgctgtgggttttagaccacactaaaacttcatttgggagacggaagttaaagaagtgggtgacccagccactccttaaattaagggaaataaatgcccggcttgatgctgtatcggaagttctccattcagaatctagtgtgtttggtcagatagaaaatcatctacgtaaattgcccgacatagagaggggactctgtagcatttatcacaaaaaatgttctacccaagagttcttcttgattgtcaaaactttatatcacctaaagtcagaatttcaagcaataatacctgctgttaattcccacattcagtcagacttgctccggaccgttattttagaaattcctgaactcctcagtccagtggagcattacttaaagatactcaatgaacaagctgccaaagttggggataaaactgaattatttaaagacctttctgacttccctttaataaaaaagaggaaggatgaaattcaaggtgttattgacgagatccgaatgcatttgcaagaaatacgaaaaatactaaaaaatccttctgcacaatatgtgacagtatcaggacaggagtttatgatagaaataaagaactctgctgtatcttgtataccaactgattgggtaaaggttggaagcacaaaagctgtgagccgctttcactctccttttattgtagaaaattacagacatctgaatcagctccgggagcagctagtccttgactgcagtgctgaatggcttgattttctagagaaattcagtgaacattatcactccttgtgtaaagcagtgcatcacctagcaactgttgactgcattttctccctggccaaggtcgctaagcaaggagattactgcagaccaactgtacaagaagaaagaaaaattgtaataaaaaatggaaggcaccctgtgattgatgtgttgctgggagaacaggatcaatatgtcccaaataatacagatttatcagaggactcagagagagtaatgataattaccggaccaaacatgggtggaaagagctcctacataaaacaagttgcattgattaccatcatggctcagattggctcctatgttcctgcagaagaagcgacaattgggattgtggatggcattttcacaaggatgggtgctgcagacaatatatataaaggacagagtacatttatggaagaactgactgacacagcagaaataatcagaaaagcaacatcacagtccttggttatcttggatgaactaggaagagggacgagcactcatgatggaattgccattgcctatgctacacttgagtatttcatcagagatgtgaaatccttaaccctgtttgtcacccattatccgccagtttgtgaactagaaaaaaattactcacaccaggtggggaattaccacatgggattcttggtcagtgaggatgaaagcaaactggatccaggcgcagcagaacaagtccctgattttgtcaccttcctttaccaaataactagaggaattgcagcaaggagttatggattaaatgtggctaaactagcagatgttcctggagaaattttgaagaaagcagctcacaagtcaaaagagctggaaggattaataaatacgaaaagaaagagactcaagtattttgcaaagttatggacgatgcataatgcacaagacctgcagaagtggacagaggagttcaacatggaagaaacacagacttctcttcttcattaaaatgaagactacatttgtgaacaaaaaatggagaattaaaaataccaactgtacaaaataactctccagtaacagcctatctttgtgtgacatgtgagcataaaattatgaccatggtatattcctattggaaacagagaggtttttctgaagacagtctttttcaagtttctgtcttcctaacttttctacgtataaacactcttgaatagacttccactttgtaattagaaaattttatggacagtaagtccagtaaagccttaagtggcagaatataattcccaagcttttggagggtgatataaaaatttacttgatatttttatttgtttcagttcagataattggcaactgggtgaatctggcaggaatctatccattgaactaaaataattttattatgcaaccagtttatccaccaagaacataagaattttttataagtagaaagaattggccaggcatggtggctcatgcctgtaatcccagcactttgggaggccaaggtaggcagatcacctgaggtcaggagttcaagaccagcctggccaacatggcaaaaccccatctttactaaaaatataaagtacatctctactaaaaatacgaaaaaattagctgggcatggtggcgcacacctgtagtcccagctactccggaggctgaggcaggagaatctcttgaacctgggaggcggaggttgcaatgagccgagatcacgtcactgcactccagcttgggcaacagagcaagactccatctcaaaaaaaaaaaaagaaaaaagaaaagaaatagaattatcaagcttttaaaaactagagcacagaaggaataaggtcatgaaatttaaaaggttaaatattgtcataggattaagcagtttaaagattgttggatgaaattatttgtcattcattcaagtaataaatatttaatgaatacttgctataaaaaaaaaaaaaaaaaaaaaaaaaa

SEQ ID NO: 92 - DNA, 7667 bp, Homo sapiens
ggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaaaaaaattagaaacaaaaaaaagattgtttctctttcatattaaagtttgggaaggcaatccagagcccatatgacattatgcagggtcagggatccgggttctttctatattgttcctccccattctcaacctgtagctttttttttttttcttttaatgagatagggtctcactctgttgcccaggctggagtgcagtggcacacttctggctcacttcagcctggaactcccgggctcgagctatattctcccactttagcctcagcctccagagtacctgggactacaggtacacaccaccatgcctggctaaattttttttttttttttttggtagagatgaggtcattgctatgttgcccaggctggccttgaagtccagggcttaagtgatcctcctgccttggcctcccaaagtgctggtgttacaggtgtgagccaccacacctggccaacatgtggctttcagttcttacttgaagacagctgctctagctagaaacttcctatcggcatctgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagatgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcagcctcctaaatgctgggattacaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatattttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaaccacca

SEQ ID NO: 93 - DNA, 2379 bp, Homo sapiens
gacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaa

SEQ ID NO: 94 - DNA, 4093 bp, Homo sapiens
gtgagagagtgagcgagacagaaagagagagaagtgcaccagcgagccggggcaggaagaggaggtttcgccaccggagcggcccggcgacgcgctgacagcttcccctgcccttcccgtcggtcgggccgccagccgccgcagccctcggcctgcacgcagccaccggccccgctcccggagcccagcgccgccgaggccgcagccgcccggccagtaaggcggcgccgccgcccggccaccgcgcgccctgcgcttccctccgcccgcgctgcggccatggcgcggcgctgactggcctggcccggccccgccgcgctcccgctcgccccgacccgcactcgggcccgcccgggctccggcctgccgccgcctcttccttctccagccggcaggcccgcgccgcttaggagggagagcccacccgcgccaggaggccgaacgcggactcgccacccggcttcagaatggcagaagatgatccatatttgggaaggcctgaacaaatgtttcatttggatccttctttgactcatacaatatttaatccagaagtatttcaaccacagatggcactgccaacagcagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttagcctgctgacaatttcccacaccgtgtaaaccaaagccctaaaattccactgcgttgtccacaagacagaagctgaagtgcatccaaaggtgctcagagagccggcccgcctgaatcattctcgatttaactcgagaccttttcaacttggcttcctttcttggttcataaatgaattttagtttggttcacttacagatagtatctagcaatcacaacactggctgagcggatgcatctggggatgaggttgcttactaagctttgccagctgctgctggatcacagctgctttctgttgtcattgctgttgtccctctgctacgttcctattgtcattaaaggtatcacggtcgccacctggcattccttctgaccacagcatcattttgcattcaaattaagggttaagaaaagagatattttaaaatgagagtcacttgatgtgccattttaaaaaaaaaggcatattgctttttctaatgtggttatttctctgatttgcaaaaaaaaaaaaaaaaaaaatacttgtcaatatttaaacatggttacaatcattgctgaaaatggtattttcccccttttctgcattttgctattgtaaatatgttttttagatcaaatactttaaaggaaaaaatgttggatttataaatgctattttttattttacttttataataaaaggaaaagcaaattgatgacctcaaaaaaaaa

SEQ ID NO: 95 - DNA, 4454 bp, Homo sapiens
gaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcagttgagtaaagcatggtgctaatggaccagggtcacagtttcaaaacttgaacaatccagttagcatcacagagaaagaaattcttctgcatttgctcattgcaccagtaactccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattctt

SEQ ID NO: 96 - DNA, 6413 bp, Homo sapiens
agaaatcagagacgctgcctgcctgctcccatctctcgcgcgctctctctctcttctgctctctccctccctttgcaaacattggatttaaacctgctcagaattcagcacagaggaaggcagcagcggtagcagcagcagaagcagtagcaagcccggcagctgagagcaccgcagcgtcgagatgtaccatcctgcctactgggtcgtcttctcggcgacaactgccctgctcttcatcccaggagtgcccgtgcgcagcggagatgccaccttccccaaagctatggacaacgtgacggtccggcagggggagagcgccaccctcaggtgtaccatagatgaccgggtaacccgggtggcctggctaaaccgcagcaccatcctctacgctgggaatgacaagtggtccatagaccctcgtgtgatcatcctggtcaatacaccaacccagtacagcatcatgatccaaaatgtggatgtgtatgacgaaggtccgtacacctgctctgtgcagacagacaatcatcccaaaacgtcccgggttcacctaatagtgcaagttcctcctcagatcatgaatatctcctcagacatcactgtgaatgagggaagcagtgtgaccctgctgtgtcttgctattggcagaccagagccaactgtgacatggagacacctgtcagtcaaggaaggccagggctttgtaagtgaggatgagtacctggagatctctgacatcaagcgagaccagtccggggagtacgaatgcagcgcgttgaacgatgtcgctgcgcccgatgtgcggaaagtaaaaatcactgtaaactatcctccctatatctcaaaagccaagaacactggtgtttcagtcggtcagaagggcatcctgagctgtgaagcctctgcagtccccatggctgaattccagtggttcaaggaagaaaccaggttagccactggtctggatggaatgaggattgaaaacaaaggccgcatgtccactctgactttcttcaatgtttcagaaaaggattatgggaactatacttgtgtggccacgaacaagcttgggaacaccaatgccagcatcacattgtatgggcctggagcagtcattgatggtgtaaactcggcctccagagcactggcttgtctctggctatcagggaccctcttagcccacttcttcatcaagttttgataagaaatcctaggtcctctgagcaacgcctgcttctccatatcacagactttaatctacactgcggagagcaaaccagcttgggcttctttttgtttttttctgttattctagatttgttttctttttgtttttgtttatttgtttgtttgcttttatttccagcttgaatgagtggggttgggggcggggtgggcagggttctaccacgtgtaggataatcattcattggtgtgtccaaaaatggggtctgctcctgctaccttgacccttccctttcctctgcttctctcctcatcatcattcccaacaacatcctctgccacacacaacaaaacgtaagtttcatttgggcaaaaattgagcctcacaataaacaccctgaagacacaacttgacttataacatagtgcacagcaagagctacatccaagtgtcctattatctgtgattattttcttaatgacaatgtacatatgcccccatccatgttaattattatctaattccattagggttcacgtcttttctttctgggacactatcctactatatccatatctatagatttcaatatagatgattgtgccatcttctgtagcccctccgctctactcattccttccaccatctgcagagatttgaagtttggggctatgcatgaaacccaacactaaattttgcaagtcaagtaaccaaaaaagggggaggcattttgaagatagaacctctattttaaaaagagaagttcaactcataaacgtgattgataggtggctgatttatttaggttttgtcaagctatctatcaaagtaatggtacagttacccatctactcaaatatctgatttatctcaccatccaattatctacccacctgtcttcctctctagcaatctatttactgtttatcaatctatcaatgtaattgtctaacactcctttctattctctccctactactcactatcaattcatccccatatgaatctctaaccatattgtatctctcccactgtattcatttatacaccatcagcagacattggcatcttcaaaattatctttcaacttctgtgaaagccaacgatctcacaggttaacaaaatacaaaagcaataccctgtgttgtggactctttaaaatctggtatcctatccacccaagggagacactaacagataggccaaagtagcaagctaatgatcagtcactcactattcccagaagagcctgtgttttctaaaacactttcttgggaagcagatcagcctagaaaagttttgattagcactgtggttttccttttgcacttgaaggacaaaggtgccagcctttatgcttctctcaacccttcaagaaagtacatgtcaggaacctatggctggctttccttagcagcaagaacttgagagaaaaacacatctgtctctgcaatgcaaagtgaagagtccacccgcctgagtgggatgacttcagctagagtctcctttctgctccagttctggtttaatctgtttgaaaactatccagtaaaaagctgatggaggccaattacatggcgggtgtattgacaactctggtatttgtttcaggaagctcttctaagctgagggcacttgagcaactgacttaattttcaagcacttgattaacacaacactgcaaacagaagggagaaagtgtcagtgacacagtttcctctgatgcagctgcttctccaatggctttggggaagaacttcaccagctcttcaggttcaaagcagacccagcatacaaacaagagctgagccacctttgctgtcttgtctcctgggacgagaaggactcatccagcaaagttgcctgggattcaaaataaaggcattgcagaccgcacaggtgtgctgcagggactgatccacagagaggatgagaatgcagcatcaatcgcagacctgccctgcctcagttggaaaaccttttcaggccctcagtctaaaaaataaaaaatatgagcaccattgaattctgtgcccttaatgcttaactggtcttcttcctctggtatcagtgtcctctttgtttttgtccatcaaggcacatgagtgtgacctctgccatggggaaacacacacagagatatctatacatatatacatacatacaaacataggctatcttggcacactaaatgctaagcactgtcttaagaggtagagctggtgtgagtgaaattaatgttacattttccagctgtaaacagacatctgcatttcctagtgagctgccaggagccagattcgggaaccgtaactgatgtgccaggaatggtgcattgattcccagttccagggatgatcatgagcaggcgcaaaatcagaattaaaggtcgcacatagacgtttcagatctgtcaccaccttcagcatctggagttgagttggtgtcagatagtgtatgagaattaaatgtgtcatctgagcatgctactgatgataaatttgttactttggagttgaataaatgtgaaggctgtgaagagtggacagtcttggagaacacagtgcttgaaatggacaagctggacctattcctcactccaagacttgttctacaggaaagggtccatgctcctttggccaagatcatcagaacctctcaacccaacaaggctggcttcagggccactatggaaccctgctgttcccccttccaaaggatactaagatgcccctctggtgggtacctatcccagccacgtttcagagggagagaaatgctacagttgatcctcatctgtctggggtaaagacaacaaagtaaatacaacccaaggcaactggggtactcactgggagtgaaaatgacttcttcacaacagacatatttctgcttctgtgtttttgtgtttctttggtggggatggcttcatgggagagtggctgtcacccatcattttgaagcatatagaacaacaaatgcttacacaagacaatatccacacttttccaacttcacacacggagagtacatggagaatgcctacaggctagatttgttcagggtgccagtagtgggcatggggtgggggcaaggcaggacaaaacatacaagtctgagcaagtacatctcttgcaggttttccacatgaaaaggaagccaaataagtcctgttaggagattaggtgagaggaattagcaatgtagggactctgaaacccttccccttcccaaaacagagttcatatgcacttccaccaaagtaatgccaatgaaagtgctcgtgttaaggctgcagccaagcttgtttttcagtagtttaatgtcaagtgcctgatacagtcgactgcaagtctaaacaagcatgtttagtttttctcattcttgctttaattcagggagggggagatgtagagaagtggttgtgaaaacatgtacaggctttatgcagagcactgcgcatggctgttctgctgcaactgtgctccacgaaacagaagaaaaggtaaggtgttgtgtcacaaagaggccccagtctctttcttcttacatccatgcctcttactagatgatacatttacagattgggcagtttgttctcaaaacctgggtgagaagactattcctggactctagcaacttcaaaactgaggctgggtttcagaatctttttctgcatcaattcagtcaatttgccttcaacaaagagaagtcagcaagttctatttatgctgaaagaactattccatgagaaaagcagagaaccccaaagtgggcaggcaaccccgacgagagcttatccctgtggcggcatcaggagtggctgtacattgaattttcaagtgctggttggctgtcgccagcccatggtaggaggggaggaatggcttaagatgaggtaagatctggtggtggggcatctttcctcaattccatactgactttgatcttgagaaagaaaaactggctatgcattacctaaaaccagtccaaaatgaaacagaccaacacacacacaaaagcaaattgtcaatccctttggaattaagggaagcagcataaggtttttctttttggaaaaaatgcatttattttctttttctccaacagcaagaatcttttgttttcattttgcacgtgaccttatcttggaaactcttatacccaattgcctcccctcctattattcagagcttccctgtctttttacttgaagacaaataagtttgagcacttgagtaaaacttcacaggtgtgtaagtaggaaggcaacattttcaaaaagagaccatatgatgagaacgcctaatgatcaccacatgcaaacaaacaaaactgccagtctcatttcccacatttcttacttaagagaagagaagtaaatgaaaggaagaagaaatagatttgtaattaaagatgtggcaaaaaagatagggctgagccagttcaatttagccttcaggtgcagaatacttagagtccaaagaaatgtggagtggacttaattagatgcagttgtctttatcctgaaagtagtgagctaagcctaatttccagcattttgaaagagattcctttttgtttctttccatggtgccctctttaaggcacagagttgctccacaccactgggtggagaaagaaagattgcgaaccctcgaccatccttttgaggctacattctatgttatttggcagatttataaagctatcagtaataacaatgctatgtactgcaagctgcccttgtgttagttaaagggagcatttttaatcgttcggaaattttcgtgacatgtcaagtgcagttgtgaggactgtgtgggtgaacgaaaatgtgtctgtcaagttcagagtcctttagatttaaaaaaaaattatgacttatcaatggtgccgttatagctgtgtcagacaatgggtgtgcccattctcacaattatccttcaaaaaaaatctatgttcaaatgctttaaaaatttatcacacgatacaagagtatgactttgtcagccttctagagttctttttttcttttattttctttcgtattttttccttcaaaaaatcaatgaagacttgatttctgtcaataattgtatcaagggtgaatatactacctgaattttgtgcatgttacattgtagttgtaaccttttctaattcaggatgaatacgagatggttgtgattgtgcagtgtaccaataaagttcgagaaatttgtaa

SEQ ID NO: 97 - DNA, 6574 bp, Homo sapiens
aagagcaaaaagcgaaggcgcaatctggacactgggagattcggagcgcagggagtttgagagaaacttttattttgaagagaccaaggttgagggggggcttatttcctgacagctatttacttagagcaaatgattagttttagaaggatggactataacattgaatcaattacaaaacgcggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggatgacatcggcatagactcttcagacctggtggaagacagcttcctgtaactggcggattcgaggggttccttccacttctggggccacctctggatcccgttcagaaaaccactttattgcaatgcagaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggcattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagtta

SEQ ID NO: 98 - DNA, 1138 bp, Homo sapiens
ggaccgttagggagcccaatgggcgtcgccgccaggccccgttgcagagcgcgtctagccaataggcagcggcggcgggcgggcgcgggcgacaggcggcgcagctgaggcggagcaggcgctgcggcaggagggaagatggcggacgaggagaagctgccgcccggctgggagaagcgcatgagccgcagctcaggccgagtgtactacttcaaccacatcactaacgccagccagtgggagcggcccagcggcaacagcagcagtggtggcaaaaacgggcagggggagcctgccagggtccgctgctcgcacctgctggtgaagcacagccagtcacggcggccctcgtcctggcggcaggagaagatcacccggaccaaggaggaggccctggagctgatcaacggctacatccagaagatcaagtcgggagaggaggactttgagtctctggcctcacagttcagcgactgcagctcagccaaggccaggggagacctgggtgccttcagcagaggtcagatgcagaagccatttgaagacgcctcgtttgcgctgcggacgggggagatgagcgggcccgtgttcacggattccggcatccacatcatcctccgcactgagtgagggtggggagcccaggcctggcctcggggcagggcagggcggctaggccggccagctcccccttgcccgccagccagtggccgaaccccccactccctgccaccgtcacacagtatttattgttcccacaatggctgggagggggcccttccagattgggggccctggggtccccactccctgtccatccccagttggggctgcgaccgccagattctcccttaaggaattgacttcagcaggggtgggaggctcccagacccagggcagtgtggtgggaggggtgttccaaagagaaggcctggtcagcagagccgccccgtgtccccccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactgctctgcaaaaaaaaaaaaaaaaaa

SEQ ID NO: 99 - DNA, 4507 bp, Homo sapiens
gaccaattgtcatacgacttgcagtgagcgtcaggagcacgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactgtcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagtagaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatcttaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataatgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatatcttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaattgacagatcttttctgaagaaaaaaaaaaaaaaa

SEQ ID NO: 100 - DNA, 782 bp, Homo sapiens
gtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaaaaaaaaaaa

SEQ ID NO: 101 - DNA, 2398 bp, Homo sapiens
gggaggccggatgtgagtggagcggccatttcctgtttctctgcagttttcctcagctttgggtggtggccgctgccgggcatcggcttccagtccgcggagggcgaggcggcgtggacagcggccccggcacccagcgccccgccgcccgcaagccgcgcgcccgtccgccgcgccccgagcccgccgcttcctatctcagcgccctgccgccgccgccgcggcccagcgagcggccctgatgcaggccatcaagtgtgtggtggtgggagacggagctgtaggtaaaacttgcctactgatcagttacacaaccaatgcatttcctggagaatatatccctactgtctttgacaattattctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaatttgcttttcccttgtgagtcctgcatcatttgaaaatgtccgtgcaaagtggtatcctgaggtgcggcaccactgtcccaacactcccatcatcctagtgggaactaaacttgatcttagggatgataaagacacgatcgagaaactgaaggagaagaagctgactcccatcacctatccgcagggtctagccatggctaaggagattggtgctgtaaaatacctggagtgctcggcgctcacacagcgaggcctcaagacagtgtttgacgaagcgatccgagcagtcctctgcccgcctcccgtgaagaagaggaagagaaaatgcctgctgttgtaaatgtctcagcccctcgttcttggtcctgtcccttggaacctttgtacgctttgctcaaaaaaaaacaaaaaaaaaaaacaaaaaaaaaaaacaacggtggagccttcgcactcaatgccaactttttgttacagattaatttttccataaaaccattttttgaaccaatcagtaattttaaggttttgtttgttctaaatgtaagagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaaaggacaaagacagtattttgacaaaatacgaagtggagatttacactacattgtacaaggaatgaaagtgtcacgggtaaaaactctaaaaggttaatttctgtcaaatgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcata

SEQ ID NO: 102 - DNA, 1979 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaa

SEQ ID NO: 103 - DNA, 11571 bp, Homo sapiens
ctcggcgggggcccgctcccaggcccgctcccgagcccgttccgctcccgtccgccttcttctcgccttctctccgcgtggctcctccgtcccggcgtctccaaaactgaatgagcgagcggcgcgtagggcgcgcggcggcggcggcggcggcggcggcatggagcgcagtggctgggcccggcagactttcctcctagcgctgttgctgggggcgacgctgagggcgcgcgcggcggctggctattacccccgcttttcgcccttctttttcctgtgcacccaccacggggagctggaaggggatggggagcagggcgaggtgctcatttccctgcatattgcgggcaaccccacctactacgttccgggacaagaataccatgtgacaatttcaacaagcaccttttttgacggcttgctggtgacaggactatacacatctacaagtgttcaggcatcacagagcattggaggttccagtgctttcggatttgggatcatgtctgaccaccagtttggtaaccagtttatgtgcagtgtggtagcctctcacgtgagtcacctgcccacaaccaacctcagtttcatctggattgctccacctgcgggcacaggctgtgtgaatttcatggctacagcaacacaccggggccaggttattttcaaagatgctttagcccagcagttgtgtgaacaaggagctccaacagatgtcactgtgcacccacatctagctgaaatacatagtgacagcattatcctgagagatgactttgactcctaccaccaactgcaattaaatccaaatatatgggttgaatgtaacaactgtgagactggagaacagtgtggcgcgattatgcatggcaatgccgtcaccttctgtgaaccatatggcccacgagaactgattaccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagacaagtcgttttagaagatagtctcgacccagtggacacaggcaactggcttttcttcccaggagctacagttaagcatagctgtcagtcagatgggaactccatttatttccatggaaatgaaggcagcgagttcaattttgccaccaccagggatgtagatctttccacagaagatattcaagagcaatggtcagaagaatttgagagccagcctacaggatgggatgtcttgggagctgtcattggtacagaatgtggaacgatagaatcaggcttatcaatggtcttcctcaaagatggagagaggaaattatgcactccatccatggacactaccggttatgggaacctgaggttttactttgtgatgggaggaatttgtgaccctggaaattctcatgaaaatgacataatcctgtatgcaaaaattgaaggaagaaaagagcatataacactggataccctttcctattcctcatataaggttccgtctttggtttctgtggtcatcaatcctgaacttcagactcctgctaccaaattttgtctcaggcaaaagaaccatcaaggacataataggaatgtctgggctgtagactttttccatgtcttgcctgttctcccttctacaatgtctcacatgatacagttttccatcaatctgggatgtggaacgcatcagcctggtaacagtgtcagcttggaattttctaccaaccatgggcgctcctggtccctccttcacactgaatgcttacctgagatctgtgctggaccccacctcccccacagcactgtctactcctctgaaaactacagtgggtggaaccgaataacaattccccttcctaacgcagcactaacccggaacaccaggattcgctggagacaaacaggaccaatccttggaaacatgtgggcaattgataatgtttatattggcccgtcatgtctcaaattctgttctggcagaggacagtgcactagacatggttgcaagtgtgaccctggattttctggcccagcttgtgagatggcatcccagacattcccaatgtttatttctgaaagctttggcagttccaggctctcctcttaccataacttttactctatccgtggtgctgaagtcagctttggttgtggtgtcttggccagtggtaaggccctggttttcaacaaagatgggcggcgtcagctaattacatctttccttgacagctcacaatccaggtttctccagttcacactgagactggggagcaaatctgttctgagcacgtgcagagcccctgatcagcctggtgaaggagttttgttgcattattcttatgataatgggataacttggaaactcctggagcattattcatatctcagctatcatgagcccagaataatctccgtagaactaccaggtgatgcaaagcagtttggaattcagttcagatggtggcaaccgtatcattcttcccagagagaagatgtatgggctattgatgagattatcatgacatctgtgcttttcaacagcattagtcttgactttaccaatcttgtggaggtcactcagtctctgggattctaccttggaaatgttcagccatactgtggccacgactggaccctttgttttacaggagattctaaacttgcctcaagtatgcgctatgtggaaacacaatcaatgcagataggagcatcctatatgattcagttcagtttggtgatgggatgtggccagaaatacaccccacacatggacaaccaggtgaagctggagtactcaaccaaccacggccttacctggcacctcgtccaagaagaatgccttccaagtatgccaagttgtcaggaatttacatcagcaagtatttaccatgccagtgagtttacacagtggaggagagtcatagtgcttcttccccagaaaacttggtccagtgctacccgtttccgctggagccagagctattacacagctcaagacgagtgggctttggacagcatttacattgggcagcagtgccccaacatgtgcagtgggcatggctcatgcgatcatggcatatgcaggtgtgaccaggggtaccaaggcactgaatgccacccagaagctgcccttccgtccacaattatgtcagattttgagaaccagaatggctgggagtctgactggcaagaagttattgggggagaaattgtaaaaccagaacaagggtgtggtgtcatctcttctggatcatctctgtacttcagcaaggctgggaaaagacagctggtgagttgggacctggatacttcttgggtggactttgtccagttctacatccagataggcggagagagtgcttcatgcaacaagcctgacagcagagaggagggcgtcctccttcagtacagcaacaatgggggcatccagtggcacctgctagcagagatgtacttttcagacttcagcaaacccagatttgtctatctggagcttccagctgctgccaagaccccttgcaccaggttccgctggtggcagcccgtgttctcaggggaggactatgaccagtgggcagtcgatgacatcatcattctgtccgagaagcagaagcagatcatcccagttatcaatccaactttacctcagaacttttatgagaagccagcttttgattaccctatgaatcagatgagtgtgtggttgatgttggctaatgaaggaatggttaaaaatgaaaccttctgtgctgccacaccatcagcaatgatatttggaaaatcagatggagatcgatttgcagtaactcgagatttgaccctgaaacctggatatgtgctacagttcaagctaaacataggttgtgccaatcaattcagcagtactgctccagttcttcttcagtactctcatgatgctggtatgtcctggtttctggtgaaagaaggctgttacccggcttctgcaggcaaaggatgcgaaggaaactccagagaactaagtgagcccaccatgtatcacacaggggactttgaagaatggacaagaatcaccattgttattccaaggtctcttgcatccagcaagaccagattccgatggatccaggagagcagctcacagaaaaacgtgcctccatttggtttagatggagtgtacatatccgagccttgtcccagttactgcagtggccatggggactgcatttcaggagtgtgtttctgtgacctgggatatactgctgcacaaggaacctgtgtgtcaaatgtccccaatcacaatgagatgttcgataggtttgaggggaagctcagccctctgtggtacaagataacaggtgcccaggttggaactggctgtggaacacttaacgatggcaaatctctctacttcaatggccctgggaaaagggaagcccggacggtccctctggacaccaggaatatcagacttgttcaattttatatacaaattggaagcaaaacttcaggcattacctgcatcaaaccaagaactagaaatgaagggcttattgttcagtattcaaatgacaatgggatactctggcatttgcttcgagagttggacttcatgtccttcctggaaccacagatcatttccattgacctgccacaggacgcgaagacacctgcaacggcatttcgatggtggcaaccgcaacatgggaagcattcagcccagtgggctttggatgatgttcttataggaatgaatgacagctctcaaactggatttcaagacaaatttgatggctctatagatttgcaagccaactggtatcgaatccaaggaggtcaagttgatattgactgtctctctatggatactgctctgatattcactgaaaacataggaaaacctcgttatgctgagacctgggattttcatgtgtcagcatctacctttttgcagtttgaaatgagcatgggctgtagcaagcccttcagcaactcccacagtgtacagctccagtattctctgaacaatggcaaggactggcatcttgtcaccgaagagtgtgttcctccaaccattggctgtctgcattacacggaaagttcaatttacacctcggaaagattccagaattggaagcggatcactgtctaccttccactctccaccatttctcccaggacccggttcagatggattcaggccaactacactgtgggggctgattcctgggcgattgataatgttgtactggcctcagggtgcccttggatgtgctcaggacgagggatttgtgatgctggacgctgtgtgtgtgaccggggctttggtggaccctattgtgttcctgttgttcctctgccctcgattcttaaagacgatttcaatgggaatttacatcctgacctttggcctgaagtgtatggtgcagagagggggaatctgaatggtgaaaccatcaaatctggaacatctctaatttttaaaggggaaggactaaggatgcttatttcaagagatctagattgtacaaatacaatgtatgtccagttttcacttagatttatagcaaaaagtaccccagagagatctcactctattctgttacaattctccatcagtggaggaatcacttggcacctgatggatgaattttactttcctcaaacaacgaatatacttttcatcaatgttcccttgccatacactgcccaaaccaatgctacaagattcagactctggcaaccttataataacggtaagaaagaagaaatctggattgttgatgacttcattatcgatggaaataatgtaaacaaccctgtgatgctcttggatacatttgattttgggcccagagaagacaattggtttttctatcctggtggtaacatcggtctttattgtccatattcttcaaagggggcacctgaagaagattcagctatggtgtttgtttcaaatgaagttggtgagcattccattaccacccgtgacctaaatgtgaatgagaacaccatcatacaatttgagatcaacgttggctgttcgactgatagctcatccgcggatccagtgagactggaattttcaagggacttcggggcgacctggcaccttctgctgcccctctgctaccacagcagcagccacgtcagctctttatgctccaccgagcaccaccccagcagcacctactacgcaggaaccatgcagggctggaggagggaggtcgtgcactttgggaagctgcacctttgtggatctgtccgtttcagatggtaccagggattttaccctgccggctctcagccagtgacatgggccattgataatgtctacatcggtccccagtgtgaggagatgtgtaatggacaggggagctgtatcaatggaaccaaatgtatatgtgaccctggctactcaggtccaacctgtaaaataagcaccaaaaatcctgattttctcaaagatgatttcgaaggtcagctagaatctgatagattcttattaatgagtggtgggaaaccatctcgaaagtgtggaatcctttctagtggaaacaacctctttttcaatgaagatggcttgcgcatgttgatgacacgagacctggatttatcacatgctagatttgtgcagttcttcatgagactgggatgtggtaaaggcgttcctgaccccaggagtcaacccgtgctcctacagtattctctcaacggtggcctctcgtggagtcttcttcaggagttccttttcagcaattccagcaatgtgggcaggtacattgccctggagatacccttgaaagcccgttctggttctactcgccttcgctggtggcaaccgtctgagaatgggcacttctacagcccctgggttatcgatcagattcttattggaggaaatatttctggtaatacggtcttggaagatgatttcacaacccttgatagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacactttcaacaagtggactagaatcactctgcctctccctccttataccaggtcccaagccactcgtttccgttggcatcaaccagctccttttgacaagcagcagacatgggcaatagataatgtctatatcggggatggctgcatagacatgtgcagtggccatgggagatgcatccagggaaactgcgtctgtgatgaacagtggggtggcctgtactgtgatgaccccgagacctctcttccaacccaactcaaagacaacttcaatcgagctccatccagtcagaactggctgactgtgaacggagggaaattgagtacagtgtgtggagccgtggcgtcgggaatggctctccatttcagtgggggttgtagtcgattattagtcactgtggatctaaacctcactaatgctgagttcatccaattttacttcatgtatgggtgcctgattacaccaaacaaccgtaaccaaggtgttctcttggaatattctgtcaatggaggcattacctggaacctgctcatggagattttctatgaccagtacagtaagcccggatttgtgaatatccttctccctcctgatgctaaagagattgccactcgcttccgctggtggcagccaagacatgacggcctggatcagaacgactgggccattgacaatgtcctcatctcaggctctgctgaccaaaggaccgttatgctggacaccttcagcagcgccccagtaccccagcatgagcgctcccctgcagatgccggccctgtcgggaggatcgcctttgacatgtttatggaagacaaaacttcagtgaatgagcactggctattccatgatgattgtacagtagaaagattctgtgactcccctgatggtgtgatgctctgtggcagtcatgatggacgggaggtgtatgcagtgacccatgacctgactcccactgaaggctggattatgcaattcaagatctcagttggatgtaaggtgtctgaaaaaattgcccagaatcaaattcatgtgcagtattctactgacttcggtgtgagttggaattatctggtccctcagtgcttgcctgctgacccaaaatgctctggaagtgtttctcagccatctgtattctttccaactaaagggtggaaaaggatcacctacccacttcctgaaagcttagtgggaaatccggtaaggtttaggttctatcagaagtactcagacatgcagtgggcaatcgataatttctacctgggccctggatgcttggacaactgcaggggccatggagattgcttaagggaacagtgcatctgtgatccgggatactcagggccaaactgctacttgacccacactctgaagactttcctgaaggaacgctttgacagtgaagaaatcaaacctgacttatggatgtccttagaaggtggaagtacttgcactgagtgtggaattcttgccgaggacactgcactctattttgggggatccactgtgagacaagcggttacacaagatttggatcttcgaggtgcaaagttcctgcaatactgggggcgcatcggtagtgagaacaacatgacctcttgccatcgtcccatctgccggaaggaaggcgtgctgttggactactctaccgatggaggaattacctggactttgctccatgagatggattaccagaaatacatttctgttagacacgactacatacttcttcctgaagatgccctcaccaacacaactcgacttcgctggtggcagccttttgtgatcagcaatggaattgtggtctctggggtggagcgtgctcagtgggcactggacaacattttgattggtggagcagaaatcaatcccagccaattggtggacacttttgatgatgaaggcacttcccatgaagaaaactggagtttttaccctaatgctgtaaggacagcaggattttgtggcaatccatcctttcacctctattggccaaataaaaagaaggacaagactcacaatgctctctcctcccgagaactcattatacagccaggatacatgatgcagtttaaaattgtggtgggttgtgaagccacttcttgtggtgaccttcattccgtaatgctggaatacactaaggatgcaagatcggattcctggcagctcgtacagacccagtgccttccttcctcttctaacagcattggctgctcccctttccagttccatgaagccaccatctacaactctgtcaacagctcaagctggaaaagaatcaccatccagctgcctgaccatgtctcctctagtgcaacacagttccgctggatccagaagggagaagaaactgagaagcaaagctgggcaattgaccacgtgtacattggagaggcttgccccaagctctgcagcgggcacggatactgcacgaccggtgccatctgcatctgcgacgagagcttccaaggtgatgactgctctgttttcagtcacgaccttcccagttatattaaagataattttgagtccgcaagagtcaccgaggcaaactgggagaccattcaaggtggagtcataggaagtggctgtgggcagctggccccctacgcccatggagactcactgtactttaatggctgtcagatcaggcaagcagctaccaagcctctggatctcactcgagcaagcaaaatcatgtttgttttgcaaattgggagcatgtcgcagacggacagctgcaacagtgacctgagtggcccccacgctgtggacaaggcagtgctgctgcaatacagcgtcaacaacgggatcacctggcatgtcatcgcccagcaccagccaaaggacttcacacaagctcagagagtgtcttacaatgtccccctggaggcacggatgaaaggagtcttactgcgctggtggcaaccacgccacaatggaacaggtcatgatcaatgggctttggaccatgtggaggtcgtcctagtaagcactcgcaaacaaaattacatgatgaatttttcacgacaacatgggctcagacatttctacaacagaagacgaaggtcacttaggcgatacccatgaagaatcaaaaagtttattttttttcttccaacatgtgatgtgttgctctccattcttttaaatctcgcactacatctgatatcaggaaatatctgtgaaggacttggtgattacctgaaagcccttctcaagaccgagtgtacaccactttcccacactgtgaactaatgacaagtgacttatttgctcataagtaaatgtcttcatgttgatgtgtccgtgaaagttgtgatctgttgtaatatcagttacagtggcagtattgacaataagaaacagtttaacagaaaaatgaaatttaagcacaaaaaatttaagagattttatgtttaaaatggcatttagcacagtatttaacattcttggtcacaaagctatttaagtggactgtatttcggctatgtctcatgttttatatgattaaattatcattgtttgtcctttatgtattctcttctacaatacaacacattgaaactgtatttacttgttatgttgtaatattttgctgctgaatttggggctacttatattctgcagaaaattaattgaaatacctattcaagaagatagttgtaaagatattgtatctcctttaatatactccttaaaaatgtatgttggtttagcgttgttttgtggataagaaaaatgcttgaccctgaaatattttctactttaaattgtggatgaagaccctatctcccacaaataagttcccatttccttgtctaaagatctttttttaagtgttctgtggctgatttactaacagtaactgccattttttgtctgtgataacagagtgatttgtaaaacagtggttgttttttcattgtgttttcttcgtggattgttttttctgcgggtcatattcataccttctgatgaagttgtacaacaccagcaacattataatggccctgtagctctgaatgctatttgtgtaactgaaaggttgcactctagggtgaaccaagctataaaagcccatgcttaaataaaaattatgtccaaaagccattgaa

SEQ ID NO: 104 - DNA, 1926 bp, Homo sapiens
gtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgagcaatggctgccatccggaagaaactggtgattgttggtgatggagcctgtggaaagacatgcttgctcatagtcttcagcaaggaccagttcccagaggtgtatgtgcccacagtgtttgagaactatgtggcagatatcgaggtggatggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcatctggctctaattcacagtgctcttttctcctcactgtatccaggttccctcccagaggagccaccagttctcatgggtggcactcagtctctcttctctccagctgactaaactttttttctgtaccagttaatttttccaactactaatagaataaaggcagttttctaaaaaaa

SEQ ID NO: 105 - DNA, 2005 bp, Homo sapiens
caacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctataaaaaaaaaaaaaaa

SEQ ID NO: 106 - DNA, 3088 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 107 - DNA, 1216 bp, Homo sapiens
ggcagctgcacggctcctggccccggagcatgcgcgagagccgccccggagcgccccggagccccccgccgtcccgcccgcggcgtcccgcgccccgccgccagcgcacccccggacgctatggcccacccctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttt

SEQ ID NO: 108 - DNA, 4978 bp, Homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacagttgggacccctgattttagcaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggtagcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 109 - DNA, 8332 bp, Homo sapiens
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 110 - DNA, 4018 bp, Homo sapiens
caggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 111 - DNA, 4326 bp, Homo sapiens
gtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaaaaaaaaaaaaaaaaaa

SEQ ID NO: 112 - DNA, 2217 bp, Homo sapiens
ccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggaaaaaaaaaaaaaaaaaa

SEQ ID NO: 113 - DNA, 5781 bp, Homo sapiens
tagcttcctcttgctgtttctttagccactggtctgcaggcgttttcttcttctaacttcctctcctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattcacagggccactgctgctcacagaagcagtgaggatgatgccaggatgatgtctgcctcgcgcctggctgggactctgatcccagccatggccttcctctcctgcgtgagaccagaaagctgggagccctgcgtggagacttggccctaaaccacacagaagagctggcatgaaacccagagctttcagactccggagcctcagcccttcaccccgattccattgcttcttgctaaatgctgccgttttatcacggaggtggttcctaatattacttatcaatgcatggagctgaatttctacaaaatccccgacaacctccccttctcaaccaagaacctggacctgagctttaatcccctgaggcatttaggcagctatagcttcttcagtttcccagaactgcaggtgctggatttatccaggtgtgaaatccagacaattgaagatggggcatatcagagcctaagccacctctctaccttaatattgacaggaaaccccatccagagtttagccctgggagccttttctggactatcaagtttacagaagctggtggctgtggagacaaatctagcatctctagagaacttccccattggacatctcaaaactttgaaagaacttaatgtggctcacaatcttatccaatctttcaaattacctgagtatttttctaatctgaccaatctagagcacttggacctttccagcaacaagattcaaagtatttattgcacagacttgcgggttctacatcaaatgcccctactcaatctctctttagacctgtccctgaaccctatgaactttatccaaccaggtgcatttaaagaaattaggcttcataagctgactttaagaaataattttgatagtttaaatgtaatgaaaacttgtattcaaggtctggctggtttagaagtccatcgtttggttctgggagaatttagaaatgaaggaaacttggaaaagtttgacaaatctgctctagagggcctgtgcaatttgaccattgaagaattccgattagcatacttagactactacctcgatgatattattgacttatttaattgtttgacaaatgtttcttcattttccctggtgagtgtgactattgaaagggtaaaagacttttcttataatttcggatggcaacatttagaattagttaactgtaaatttggacagtttcccacattgaaactcaaatctctcaaaaggcttactttcacttccaacaaaggtgggaatgctttttcagaagttgatctaccaagccttgagtttctagatctcagtagaaatggcttgagtttcaaaggttgctgttctcaaagtgattttgggacaaccagcctaaagtatttagatctgagcttcaatggtgttattaccatgagttcaaacttcttgggcttagaacaactagaacatctggatttccagcattccaatttgaaacaaatgagtgagttttcagtattcctatcactcagaaacctcatttaccttgacatttctcatactcacaccagagttgctttcaatggcatcttcaatggcttgtccagtctcgaagtcttgaaaatggctggcaattctttccaggaaaacttccttccagatatcttcacagagctgagaaacttgaccttcctggacctctctcagtgtcaactggagcagttgtctccaacagcatttaactcactctccagtcttcaggtactaaatatgagccacaacaacttcttttcattggatacgtttccttataagtgtctgaactccctccaggttcttgattacagtctcaatcacataatgacttccaaaaaacaggaactacagcattttccaagtagtctagctttcttaaatcttactcagaatgactttgcttgtacttgtgaacaccagagtttcctgcaatggatcaaggaccagaggcagctcttggtggaagttgaacgaatggaatgtgcaacaccttcagataagcagggcatgcctgtgctgagtttgaatatcacctgtcagatgaataagaccatcattggtgtgtcggtcctcagtgtgcttgtagtatctgttgtagcagttctggtctataagttctattttcacctgatgcttcttgctggctgcataaagtatggtagaggtgaaaacatctatgatgcctttgttatctactcaagccaggatgaggactgggtaaggaatgagctagtaaagaatttagaagaaggggtgcctccatttcagctctgccttcactacagagactttattcccggtgtggccattgctgccaacatcatccatgaaggtttccataaaagccgaaaggtgattgttgtggtgtcccagcacttcatccagagccgctggtgtatctttgaatatgagattgctcagacctggcagtttctgagcagtcgtgctggtatcatcttcattgtcctgcagaaggtggagaagaccctgctcaggcagcaggtggagctgtaccgccttctcagcaggaacacttacctggagtgggaggacagtgtcctggggcggcacatcttctggagacgactcagaaaagccctgctggatggtaaatcatggaatccagaaggaacagtgggtacaggatgcaattggcaggaagcaacatctatctgaagaggaaaaataaaaacctcctgaggcatttcttgcccagctgggtccaacacttgttcagttaataagtattaaatgctgccacatgtcaggccttatgctaagggtgagtaattccatggtgcactagatatgcagggctgctaatctcaaggagcttccagtgcagagggaataaatgctagactaaaatacagagtcttccaggtgggcatttcaaccaactcagtcaaggaacccatgacaaagaaagtcatttcaactcttacctcatcaagttgaataaagacagagaaaacagaaagagacattgttcttttcctgagtcttttgaatggaaattgtattatgttatagccatcataaaaccattttggtagttttgactgaactgggtgttcactttttcctttttgattgaatacaatttaaattctacttgatgactgcagtcgtcaaggggctcctgatgcaagatgccccttccattttaagtctgtctccttacagaggttaaagtctagtggctaattcctaaggaaacctgattaacacatgctcacaaccatcctggtcattctcgagcatgttctattttttaactaatcacccctgatatatttttatttttatatatccagttttcatttttttacgtcttgcctataagctaatatcataaataaggttgtttaagacgtgcttcaaatatccatattaaccactatttttcaaggaagtatggaaaagtacactctgtcactttgtcactcgatgtcattccaaagttattgcctactaagtaatgactgtcatgaaagcagcattgaaataatttgtttaaagggggcactcttttaaacgggaagaaaatttccgcttcctggtcttatcatggacaatttgggctagaggcaggaaggaagtgggatgacctcaggaggtcaccttttcttgattccagaaacatatgggctgataaacccggggtgacctcatgaaatgagttgcagcagaagtttatttttttcagaacaagtgatgtttgatggacctctgaatctctttagggagacacagatggctgggatccctcccctgtacccttctcactgccaggagaactacgtgtgaaggtattcaaggcagggagtatacattgctgtttcctgttgggcaatgctccttgaccacattttgggaagagtggatgttatcattgagaaaacaatgtgtctggaattaatggggttcttataaagaaggttcccagaaaagaatgttcatccagcctcctcagaaacagaacattcaagaaaaggacaatcaggatgtcatcagggaaatgaaaataaaaaccacaatgagatatcaccttataccaggtagaatggctactataaaaaaatgaagtgtcatcaaggatatagagaaattggaacccttcttcactgctggagggaatggaaaatggtgtagccgttatgaaaaacagtacggaggtttctcaaaaattaaaaatagaactgctatatgatccagcaatctcacttctgtatatatacccaaaataattgaaatcagaatttcaagaaaatatttacactcccatgttcattgtggcactcttcacaatcactgtttccaaagttatggaaacaacccaaatttccattgaaaaataaatggacaaagaaaatgtgcatatacgtacaatgggatattattcagcctaaaaaaagggggaatcctgttatttatgacaacatgaataaacccggaggccattatgctatgtaaaatgagcaagtaacagaaagacaaatactgcctgatttcatttatatgaggttctaaaatagtcaaactcatagaagcagagaatagaacagtggttcctagggaaaaggaggaagggagaaatgaggaaatagggagttgtctaattggtataaaattatagtatgcaagatgaattagctctaaagatcagctgtatagcagagttcgtataatgaacaatactgtattatgcacttaacattttgttaagagggtacctctcatgttaagtgttcttaccatatacatatacacaaggaagcttttggaggtgatggatatatttattaccttgattgtggtgatggtttgacaggtatgtgactatgtctaaactcatcaaattgtatacattaaatatatgcagttttataatatcaattatgtctgaatgaagctataaaaaagaaaagacaacaaaattcagttgtcaaaactggaaatatgaccacagtcagaagtgtttgttactgagtgtttcagagtgtgtttggtttgagcaggtctagggtgattgaacatccctgggtgtgtttccatgtctcatgtactagtgaaagtagatgtgtgcatttgtgcacatatccctatgtatccctatcagggctgtgtgtatttgaaagtgtgtgtgtccgcatgatcatatctgtatagaagagagtgtgattatatttcttgaagaatacatccatttgaaatggatgtctatggctgtttgagatgagttctctactcttgtgcttgtacagtagtctccccttatcccttatgcttggtggatacgttcttagaccccaagtggatctctgagaccgcagatggtaccaaacctcatatatgcaatattttttcctatacataaatacctaagataaagttcatcttctgaattaggcacagtaagagattaacaataactaacaataaaattgaatagttataataatatattgtaataaaagttatgtgaatgtgatctctttctttctctctctcaaaat

SEQ ID NO: 114 - DNA, 4154 bp, Homo sapiens
acttggacgcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 115 - DNA, 3677 bp, Homo sapiens
tcgcggaggcttggggcagccgggtagctcggaggtcgtggcgctgggggctagcaccagcgctctgtcgggaggcgcagcggttaggtggaccggtcagcggactcaccggccagggcgctcggtgctggaatttgatattcattgatccgggttttatccctcttcttttttcttaaacatttttttttaaaactgtattgtttctcgttttaatttatttttgcttgccattccccacttgaatcgggccgacggcttggggagattgctctacttccccaaatcactgtggattttggaaaccagcagaaagaggaaagaggtagcaagagctccagagagaagtcgaggaagagagagacggggtcagagagagcgcgcgggcgtgcgagcagcgaaagcgacaggggcaaagtgagtgacctgcttttgggggtgaccgccggagcgcggcgtgagccctcccccttgggatcccgcagctgaccagtcgcgctgacggacagacagacagacaccgcccccagccccagctaccacctcctccccggccggcggcggacagtggacgcggcggcgagccgcgggcaggggccggagcccgcgcccggaggcggggtggagggggtcggggctcgcggcgtcgcactgaaacttttcgtccaacttctgggctgttctcgcttcggaggagccgtggtccgcgcgggggaagccgagccgagcggagccgcgagaagtgctagctcgggccgggaggagccgcagccggaggagggggaggaggaagaagagaaggaagaggagagggggccgcagtggcgactcggcgctcggaagccgggctcatggacgggtgaggcggcggtgtgcgcagacagtgctccagccgcgcgcgctccccaggccctggcccgggcctcgggccggggaggaagagtagctcgccgaggcgccgaggagagcgggccgccccacagcccgagccggagagggagcgcgagccgcgccggccccggtcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaaaaaatcagttcgaggaaagggaaaggggcaaaaacgaaagcgcaagaaatcccggtataagtcctggagcgtgtacgttggtgcccgctgctgtctaatgccctggagcctccctggcccccatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagggtttcgggaaccagatctctcaccaggaaagactgatacagaacgatcgatacagaaaccacgctgccgccaccacaccatcaccatcgacagaacagtccttaatccagaaacctgaaatgaaggaagaggagactctgcgcagagcactttgggtccggagggcgagactccggcggaagcattcccgggcgggtgacccagcacggtccctcttggaattggattcgccattttatttttcttgctgctaaatcaccgagcccggaagattagagagttttatttctgggattcctgtagacacacccacccacatacatacatttatatatatatatattatatatatataaaaataaatatctctattttatatatataaaatatatatattctttttttaaattaacagtgctaatgttattggtgtcttcactggatgtatttgactgctgtggacttgagttgggaggggaatgttcccactcagatcctgacagggaagaggaggagatgagagactctggcatgatcttttttttgtcccacttggtggggccagggtcctctcccctgcccaggaatgtgcaaggccagggcatgggggcaaatatgacccagttttgggaacaccgacaaacccagccctggcgctgagcctctctaccccaggtcagacggacagaaagacagatcacaggtacagggatgaggacaccggctctgaccaggagtttggggagcttcaggacattgctgtgctttggggattccctccacatgctgcacgcgcatctcgcccccaggggcactgcctggaagattcaggagcctgggcggccttcgcttactctcacctgcttctgagttgcccaggagaccactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctccatcccctggtccttcccttcccttcccgaggcacagagagacagggcaggatccacgtgcccattgtggaggcagagaaaagagaaagtgttttatatacggtacttatttaatatccctttttaattagaaattaaaacagttaatttaattaaagagtagggttttttttcagtattcttggttaatatttaatttcaactatttatgagatgtatcttttgctctctcttgctctcttatttgtaccggtttttgtatataaaattcatgtttccaatctctctctccctgatcggtgacagtcactagcttatcttgaacagatatttaattttgctaacactcagctctgccctccccgatcccctggctccccagcacacattcctttgaaataaggtttcaatatacatctacatactatatatatatttggcaacttgtatttgtgtgtatatatatatatatatgtttatgtatatatgtgattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatatttatttttaaacaacgacaaagaaatacagatatatcttaaaaaaaaaaaagcattttgtattaaagaatttaattctgatctcaaaaaaaaaaaaaaaaaa

SEQ ID NO: 116 - DNA, 3037 bp, Homo sapiens
agctggggtaaggagttcaaggcagcgcccacacccgggggctctccgcaacccgaccgcctgtccgctcccccacttcccgccctccctcccacctactcattcacccacccacccacccagagccgggacggcagcccaggcgcccgggccccgccgtctcctcgccgcgatcctggacttcctcttgctgcaggacccggcttccacgtgtgtcccggagccggcgtctcagcacacgctccgctccgggcctgggtgcctacagcagccagagcagcagggagtccgggacccgggcggcatctgggccaagttaggcgccgccgaggccagcgctgaacgtctccagggccggaggagccgcggggcgtccgggtctgagccgcagcaaatgggctccgacgtgcgggacctgaacgcgctgctgcccgccgtcccctccctgggtggcggcggcggctgtgccctgcctgtgagcggcgcggcgcagtgggcgccggtgctggactttgcgcccccgggcgcttcggcttacgggtcgttgggcggccccgcgccgccaccggctccgccgccacccccgccgccgccgcctcactccttcatcaaacaggagccgagctggggcggcgcggagccgcacgaggagcagtgcctgagcgccttcactgtccacttttccggccagttcactggcacagccggagcctgtcgctacgggcccttcggtcctcctccgcccagccaggcgtcatccggccaggccaggatgtttcctaacgcgccctacctgcccagctgcctcgagagccagcccgctattcgcaatcagggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttgaggggtctccctcggggaccgttcagtgtcccaggcagcacagtgtgtgaactgctttcaagtctgactctccactcctcctcactaaaaaggaaacttcagttgatcttcttcatccaacttccaagacaagataccggtgcttctggaaactaccaggtgtgcctggaagagttggtctctgccctgcctacttttagttgactcacaggccctggagaagcagctaacaatgtctggttagttaaaagcccattgccatttggtgtggattttctactgtaagaagagccatagctgatcatgtccccctgacccttcccttctttttttatgctcgttttcgctggggatggaattattgtaccattttctatcatggaatatttataggccagggcatgtgtatgtgtctgctaatgtaaactttgtcatggtttccatttactaacagcaacagcaagaaataaatcagagagcaaggcatcgggggtgaatcttgtctaacattcccgaggtcagccaggctgctaacctggaaagcaggatgtagttctgccaggcaacttttaaagctcatgcatttcaagcagctgaagaaaaaatcagaactaaccagtacctctgtatagaaatctaaaagaattttaccattcagttaattcaatgtgaacactggcacactgctcttaagaaactatgaagatctgagatttttttgtgtatgtttttgactcttttgagtggtaatcatatgtgtctttatagatgtacatacctccttgcacaaatggaggggaattcattttcatcactgggagtgtccttagtgtataaaaaccatgctggtatatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgtgtgtgttgtgttgtgttttgttttttaagggagggaatttattatttaccgttgcttgaaattactgtgtaaatatatgtctgataatgatttgctctttgacaactaaaattaggactgtataagtactagatgcatcactgggtgttgatcttacaagatattgatgataacacttaaaattgtaacctgcatttttcactttgctctcaattaaagtctattcaaaaggaaaaaaaaaaaaa

SEQ ID NO: 117 - DNA, 8460 bp, Homo sapiens
gctggggccaagccgcagagcggagttggcatttccagattggggctcgggccgcgcctcctccgggaccctccccttggaccgagccgatcgccgcggggcagttcgggccggctgtcctggcgcgaaaaggtggacaagtcctattttcaagagaagatgacttttaacagttttgaaggatctaaaacttgtgtacctgcagacatcaataaggaagaagaatttgtagaagagtttaatagattaaaaacttttgctaattttccaagtggtagtcctgtttcagcatcaacactggcacgagcagggtttctttatactggtgaaggagataccgtgcggtgctttagttgtcatgcagctgtagatagatggcaatatggagactcagcagttggaagacacaggaaagtatccccaaattgcagatttatcaacggcttttatcttgaaaatagtgccacgcagtctacaaattctggtatccagaatggtcagtacaaagttgaaaactatctgggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctaaccccaagagagttagcaagtgctggactctactacacaggtattggtgaccaagtgcagtgcttttgttgtggtggaaaactgaaaaattgggaaccttgtgatcgtgcctggtcagaacacaggcgacactttcctaattgcttctttgttttgggccggaatcttaatattcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagaagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggtgagtaaggcatgttactacagaggaaagtttgagagtaaaactgtaaaaaattatatttttgttgtactttctaagagaaagagtattgttatgttctcctaacttctgttgattactactttaagtgatattcatttaaaacattgcaaatttattttatttatttaattttctttttgagatggagtcttgcttgtcacccaggctggagtgcagtggagtgatctctgctcactgcaacctccgccttctgggttcaagcgattctcgtgcctcagcttcctgagtagctggaattacaggcaggtgccaccatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagttttaaaaattaaataatgactgccctgtttctgttttagtatgtaaatcctcagttcttcacctttgcactgtctgccacttagtttggttatatagtcattaacttgaatttggtctgtatagtctagactttaaatttaaagttttctacaaggggagaaaagtgttaaaatttttaaaatatgttttccaggacacttcacttccaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttacattttagtcatgcaaagattcaagtagttttgcaataagtacttatctttatttgtaataatttagtctgctgatcaaaagcattgtcttaatttttgagaactggttttagcatttacaaactaaattccagttaattaattaatagctttatattgcctttcctgctacatttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaatgaaataaaatggggctgggctcagtggctcacgcctgtaatcccagcactttgggaggctgaggcaggtggatcacgaggtcaggagatcgagaccatcctggctaacacggtgaaaccccgtctctactaaaaaacagaaaattagccgggcgtggtggcgggcgcctgtagtcccagctactcgggaggctgaggcaggagaatggtgtgaacccgggaggcagagcttgcagtgagccgagatctcgccactgcactccagcctgggcaacagagcaagactctgtctcaaaaaaaaaaaaaaaagaaataagaaaatgggaagcaatatttgacatagttctttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacctggaaatttgggctaaaacttagaaaaaattcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctcaaaaaaaaaaaaagatataaatcacaataaataaataggtcaatacaaatgttagccaggcgtggtggcacatgcccatagtcgcagctactctggaggcagaggcaggaggatcacttgagcccatgaatttgaggcagcagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcaataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagctaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatgcatatatagccagcccttcatatctgtgggttttgcatccatggattcaaccaaggaggaattgaaaacactgagaaaaaaaaaaaagaccacacaataaaaaaaaaaaatacaaaataatacaaagaaaaagccaaaattgtcatactgttgttaagcaacagtataacaactatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttttttttaatttaaacagtctcactgtgttgcccaggatggagtgcaatggcacaatcttggctcatggcaaactctgcctcgcaagcagctgggactacaggcatgctccacggtgcccagttaattttttttgtattcttagtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgatctcaggtgatctgcctgcctcggcctcacaaagtgctgggattacaggtgtgaaccactgctcccggccttgtgtgattttatctaagggacttaagcgtcctcaggtcctagggggtcgtgaaaccaaaaccccagggatagcaagggacaattgtatcttcaaagtagacaaatggcgccgggcacggtggctcacgcctgtaatcccagcagtttccgaggctgaggcaggcggctcacctgaggtcaggagttggagaccagcctggccaacatgctgaaaccctgtctgtacaaaaatacaaaaatagctgggcatggtggcgcatgcctgtagtcccagctactagagcgactgaggcaggagaattgcttgaacctgggaggcggaggttgcagggagccaagatggcgccaccgcactccagcctaggtgatagagtgagactccctctcaaaaacaaaacaaaacaaaaaaattagacaaatgctacattaatgtttgggtggtcagattctactttgaatctgaagtttgcagatatgcctatagatttttggagtttaccactttcttattctgtatcattaatgtaatattttaaattactatatatgttaccatttttctggatttagtaagaaatttgcagttttggtttgatgtaacaagggttttaatgtaatttatgttagattttgcatttttttcattactgttatattttaacctgactgactgatctaattgtattagtattgtgaataatcatgtgaaatgttttgagacagagtactatatttgtgaatataattttatggtttttttcacttagaacctttctgtgtggaaaactaagaaaattgctttctgctgtataatctggcattcattgtagattaaagcttatttttctgtgaataaaacgtattcaataaaatactattctttaaaattatatcataaaaaaaaaa

SEQ ID NO: 118 - DNA, 5396 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcaggtcctcttcctgatggatgggaacaagccatgactcaggatggagaaatttactatataaaccataagaacaagaccacctcttggctagacccaaggcttgaccctcgttttgccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggcaatgcggaatatcaatcccagcacagcaaattctccaaaatgtcaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactcttaaaaaaaaaa

SEQ ID NO: 119 - RNA, 22 nt, Homo sapiens
ugagguaguagguuguauaguu

SEQ ID NO: 120 - RNA, 22 nt, Homo sapiens
uuugguccccuucaaccagcua

SEQ ID NO: 121 - RNA, 22 nt, Homo sapiens
uggagugugacaaugguguuug

SEQ ID NO: 122 - RNA, 23 nt, Homo sapiens
ucaagagcaauaacgaaaaaugu

SEQ ID NO: 123 - RNA, 22 nt, Homo sapiens
uagguaguuucauguuguuggg

SEQ ID NO: 124 - RNA, 21 nt, Homo sapiens
cauaaaguagaaagcacuacu

SEQ ID NO: 125 - RNA, 23 nt, Homo sapiens
uuuggcacuagcacauuuuugcu

SEQ ID NO: 126 - RNA, 22 nt, Homo sapiens
uggacggagaacugauaagggu

SEQ ID NO: 127 - RNA, 22 nt, Homo sapiens
acagcaggcacagacaggcagu

SEQ ID NO: 128 - RNA, 22 nt, Homo sapiens
uagcagcacauaaugguuugug

SEQ ID NO: 129 - RNA, 22 nt, Homo sapiens
ugagguaguagguugugugguu

SEQ ID NO: 130 - RNA, 22 nt, Homo sapiens
uccuucauuccaccggagucug

SEQ ID NO: 131 - RNA, 23 nt, Homo sapiens
aacauucaacgcugucggugagu

SEQ ID NO: 132 - RNA, 22 nt, Homo sapiens
cagugguuuuacccuaugguag

SEQ ID NO: 133 - RNA, 22 nt, Homo sapiens
ugagaacugaauuccauaggcu

SEQ ID NO: 134 - RNA, 23 nt, Homo sapiens
aggcaguguaguuagcugauugc

SEQ ID NO: 135 - RNA, 22 nt, Homo sapiens
ugugacugguugaccagagggg

SEQ ID NO: 136 - RNA, 22 nt, Homo sapiens
ugagguaguaguuuguacaguu

SEQ ID NO: 137 - RNA, 22 nt, Homo sapiens
ugagguaguagguuguaugguu

SEQ ID NO: 138 - RNA, 21 nt, Homo sapiens
uugugcuugaucuaaccaugu

SEQ ID NO: 139 - RNA, 22 nt, Homo sapiens
uggaauguaaggaagugugugg

SEQ ID NO: 140 - RNA, 20 nt, Homo sapiens
uaaggcacgcggugaaugcc

SEQ ID NO: 141 - RNA, 22 nt, Homo sapiens
aacccguagauccgaacuugug

SEQ ID NO: 142 - RNA, 23 nt, Homo sapiens
uacccuguagaaccgaauuugug

SEQ ID NO: 143 - RNA, 23 nt, Homo sapiens
uuaaugcuaaucgugauaggggu

SEQ ID NO: 144 - RNA, 22 nt, Homo sapiens
uggaauguaaagaaguauguau

SEQ ID NO: 145 - RNA, 22 nt, Homo sapiens
ucucccaacccuuguaccagug

SEQ ID NO: 146 - RNA, 22 nt, Homo sapiens
ugagguaguaguuugugcuguu

SEQ ID NO: 147 - RNA, 21 nt, Homo sapiens
uucacaguggcuaaguucugc

SEQ ID NO: 148 - RNA, 22 nt, Homo sapiens
cugaagcucagagggcucugau

SEQ ID NO: 149 - RNA, 23 nt, Homo sapiens
caacggaaucccaaaagcagcug

SEQ ID NO: 150 - RNA, 22 nt, Homo sapiens
ugagguaguagauuguauaguu

SEQ ID NO: 151 - RNA, 23 nt, Homo sapiens
uacccuguagauccgaauuugug

SEQ ID NO: 152 - RNA, 22 nt, Homo sapiens
uagcagcacaucaugguuuaca

SEQ ID NO: 153 - RNA, 22 nt, Homo sapiens
uagcagcacguaaauauuggcg

SEQ ID NO: 154 - RNA, 22 nt, Homo sapiens
uggcagugucuuagcugguugu

SEQ ID NO: 155 - RNA, 20 nt, Homo sapiens
uacaguauagaugauguacu

SEQ ID NO: 156 - RNA, 21 nt, Homo sapiens
ucacagugaaccggucucuuu

SEQ ID NO: 157 - RNA, 21 nt, Homo sapiens
augaccuaugaauugacagac

SEQ ID NO: 158 - RNA, 22 nt, Homo sapiens
ugggucuuugcgggcgagauga

SEQ ID NO: 159 - RNA, 21 nt, Homo sapiens
aucacauugccagggauuacc

SEQ ID NO: 160 - RNA, 22 nt, Homo sapiens
gugaaauguuuaggaccacuag

SEQ ID NO: 161 - RNA, 23 nt, Homo sapiens
uguaaacauccuacacucucagc

SEQ ID NO: 162 - RNA, 22 nt, Homo sapiens
ugagguaguagguuguaugguu

SEQ ID NO: 163 - RNA, 22 nt, Homo sapiens
ugagaacugaauuccauggguu

SEQ ID NO: 164 - RNA, 22 nt, Homo sapiens
agagguaguagguugcauaguu

SEQ ID NO: 165 - RNA, 23 nt, Homo sapiens
ucuuugguuaucuagcuguauga

SEQ ID NO: 166 - RNA, 23 nt, Homo sapiens
aacauucauugcugucggugggu

SEQ ID NO: 167 - RNA, 22 nt, Homo sapiens
aacauucaaccugucggugagu

SEQ ID NO: 168 - RNA, 23 nt, Homo sapiens
caaagugcucauagugcagguag

SEQ ID NO: 169 - RNA, 24 nt, Homo sapiens
ucccugagacccuuuaaccuguga

SEQ ID NO: 170 - RNA, 22 nt, Homo sapiens
ucagugcaucacagaacuuugu

SEQ ID NO: 171 - RNA, 22 nt, Homo sapiens
uauugcacuugucccggccugu

SEQ ID NO: 172 - RNA, 21 nt, Homo sapiens
acuggacuuggagucagaagg

SEQ ID NO: 173 - RNA, 22 nt, Homo sapiens
cagugcaauguuaaaagggcau

SEQ ID NO: 174 - RNA, 23 nt, Homo sapiens
uaaagugcuuauagugcagguag

SEQ ID NO: 175 - RNA, 22 nt, Homo sapiens
uaacagucuacagccauggucg

SEQ ID NO: 176 - RNA, 22 nt, Homo sapiens
aacuggcccucaaagucccgcu

SEQ ID NO: 177 - RNA, 22 nt, Homo sapiens
uauggcacugguagaauucacu

SEQ ID NO: 178 - RNA, 22 nt, Homo sapiens
ucagugcacuacagaacuuugu

SEQ ID NO: 179 - RNA, 23 nt, Homo sapiens
agcugguguugugaaucaggccg

SEQ ID NO: 180 - RNA, 23 nt, Homo sapiens
gaagugcuucgauuuuggggugu

SEQ ID NO: 181 - RNA, 23 nt, Homo sapiens
uagcaccauuugaaaucaguguu

SEQ ID NO: 182 - RNA, 23 nt, Homo sapiens
uauggcuuuucauuccuauguga

SEQ ID NO: 183 - RNA, 22 nt, Homo sapiens
uagcuuaucagacugauguuga

SEQ ID NO: 184 - RNA, 23 nt, Homo sapiens
aacauucauuguugucggugggu

SEQ ID NO: 185 - RNA, 23 nt, Homo sapiens
cagugcaauaguauugucaaagc

SEQ ID NO: 186 - RNA, 23 nt, Homo sapiens
uaauacugccggguaaugaugga

SEQ ID NO: 187 - RNA, 23 nt, Homo sapiens
uggaagacuagugauuuuguugu

SEQ ID NO: 188 - RNA, 22 nt, Homo sapiens
uagcaccaucugaaaucgguua

SEQ ID NO: 189 - RNA, 22 nt, Homo sapiens
cugugcgugugacagcggcuga

SEQ ID NO: 190 - RNA, 23 nt, Homo sapiens
caaagugcuuacagugcagguag

SEQ ID NO: 191 - RNA, 22 nt, Homo sapiens
ugagguaguaaguuguauuguu

SEQ ID NO: 192 - RNA, 22 nt, Homo sapiens
cauugcacuugucucggucuga

SEQ ID NO: 193 - RNA, 21 nt, Homo sapiens
ugagaugaagcacuguagcuc

SEQ ID NO: 194 - RNA, 23 nt, Homo sapiens
ugugcaaaucuaugcaaaacuga

SEQ ID NO: 195 - RNA, 23 nt, Homo sapiens
uaaggugcaucuagugcagauag

SEQ ID NO: 196 - RNA, 22 nt, Homo sapiens
ucccugagacccuaacuuguga

SEQ ID NO: 197 - RNA, 22 nt, Homo sapiens
ucguaccgugaguaauaaugcg

SEQ ID NO: 198 - RNA, 21 nt, Homo sapiens
uucacaguggcuaaguuccgc

SEQ ID NO: 199 - RNA, 23 nt, Homo sapiens
aaagugcugcgacauuugagcgu

SEQ ID NO: 200 - RNA, 23 nt, Homo sapiens
ucuggcuccgugucuucacuccc

SEQ ID NO: 201 - RNA, 22 nt, Homo sapiens
uauugcacauuacuaaguugca

SEQ ID NO: 202 - DNA, 2591 bp, Homo sapiens
cggaggtgcgcgggcgcgggcgagcagggtctccgggtgggcggcggcgacgccccgcgcaggctggaggccgccgaggctcgccatgccgggagaactctaactcccccatggagtcggccgacttctacgaggcggagccgcggcccccgatgagcagccacctgcagagccccccgcacgcgcccagcagcgccgccttcggctttccccggggcgcgggccccgcgcagcctcccgccccacctgccgccccggagccgctgggcggcatctgcgagcacgagacgtccatcgacatcagcgcctacatcgacccggccgccttcaacgacgagttcctggccgacctgttccagcacagccggcagcaggagaaggccaaggcggccgtgggccccacgggcggcggcggcggcggcgactttgactacccgggcgcgcccgcgggccccggcggcgccgtcatgcccgggggagcgcacgggcccccgcccggctacggctgcgcggccgccggctacctggacggcaggctggagcccctgtacgagcgcgtcggggcgccggcgctgcggccgctggtgatcaagcaggagccccgcgaggaggatgaagccaagcagctggcgctggccggcctcttcccttaccagccgccgccgccgccgccgccctcgcacccgcacccgcacccgccgcccgcgcacctggccgccccgcacctgcagttccagatcgcgcactgcggccagaccaccatgcacctgcagcccggtcaccccacgccgccgcccacgcccgtgcccagcccgcaccccgcgcccgcgctcggtgccgccggcctgccgggccctggcagcgcgctcaaggggctgggcgccgcgcaccccgacctccgcgcgagtggcggcagcggcgcgggcaaggccaagaagtcggtggacaagaacagcaacgagtaccgggtgcggcgcgagcgcaacaacatcgcggtgcgcaagagccgcgacaaggccaagcagcgcaacgtggagacgcagcagaaggtgctggagctgaccagtgacaatgaccgcctgcgcaagcgggtggaacagctgagccgcgaactggacacgctgcggggcatcttccgccagctgccagagagctccttggtcaaggccatgggcaactgcgcgtgaggcgcgcggctgtgggaccgccctgggccagcctccggcggggacccagggagtggtttggggtcgccggatctcgaggcttgcccgagccgtgcgagccaggactaggagattccggtgcctcctgaaagcctggcctgctccgcgtgtcccctcccttcctctgcgccggacttggtgcgtctaagatgagggggccaggcggtggcttctccctgcgaggaggggagaattcttggggctgagctgggagcccggcaactctagtatttaggataaccttgtgccttggaaatgcaaactcaccgctccaatgcctactgagtagggggagcaaatcgtgccttgtcattttatttggaggtttcctgcctccttcccgaggctacagcagacccccatgagagaaggaggggagcaggcccgtggcaggaggagggctcagggagctgagatcccgacaagcccgccagccccagccgctcctccacgcctgtccttagaaaggggtggaaacatagggacttggggcttggaacctaaggttgttcccctagttctacatgaaggtggagggtctctagttccacgcctctcccacctccctccgcacacaccccaccccagcctgctataggctgggcttccccttggggcggaactcactgcgatgggggtcaccaggtgaccagtgggagcccccaccccgagtcacaccagaaagctaggtcgtgggtcagctctgaggatgtatacccctggtgggagagggagacctagagatctggctgtggggcgggcatggggggtgaagggccactgggaccctcagccttgtttgtactgtatgccttcagcattgcctaggaacacgaagcacgatcagtccatcccagagggaccggagttatgacaagctttccaaatattttgctttatcagccgatatcaacacttgtatctggcctctgtgccccagcagtgccttgtgcaatgtgaatgtgcgcgtctctgctaaaccaccattttatttggtttttgttttgttttggttttgctcggatacttgccaaaatgagactctccgtcggcagctgggggaagggtctgagactccctttccttttggttttgggattacttttgatcctgggggaccaatgaggtgaggggggttctcctttgccctcagctttccccagcccctccggcctgggctgcccacaaggcttgtcccccagaggccctggctcctggtcgggaagggaggtggcctcccgccaacgcatcactggggctgggagcagggaaggacggcttggttctcttcttttggggagaacgtagagtctcactctagatgttttatgtattatatctataatataaacatatcaaagtcaa

SEQ ID NO: 203 - DNA, 2113 bp, Homo sapiens
tcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagtaaaaaaa

SEQ ID NO: 204 - DNA, 1269 bp, Homo sapiens
aggtgacagcctcgcttggacgcagagcccggcccgacgccgccatgagcgccgcgctcttcagcctggacggcccggcgcgcggcgcgccctggcctgcggagcctgcgcccttctacgaaccgggccgggcgggcaagccgggccgcggggccgagccaggggccctaggcgagccaggcgccgccgcccccgccatgtacgacgacgagagcgccatcgacttcagcgcctacatcgactccatggccgccgtgcccaccctggagctgtgccacgacgagctcttcgccgacctcttcaacagcaatcacaaggcgggcggcgcggggcccctggagcttcttcccggcggccccgcgcgccccttgggcccgggccctgccgctccccgcctgctcaagcgcgagcccgactggggcgacggcgacgcgcccggctcgctgttgcccgcgcaggtggccgcgtgcgcacagaccgtggtgagcttggcggccgcagggcagcccaccccgcccacgtcgccggagccgccgcgcagcagccccaggcagacccccgcgcccggccccgcccgggagaagagcgccggcaagaggggcccggaccgcggcagccccgagtaccggcagcggcgcgagcgcaacaacatcgccgtgcgcaagagccgcgacaaggccaagcggcgcaaccaggagatgcagcagaagttggtggagctgtcggctgagaacgagaagctgcaccagcgcgtggagcagctcacgcgggacctggccggcctccggcagttcttcaagcagctgcccagcccgcccttcctgccggccgccgggacagcagactgccggtaacgcgcggccggggcgggagagactcagcaacgacccatacctcagacccgacggcccggagcggagcgcgccctgccctggcgcagccagagccgccgggtgcccgctgcagtttcttgggacataggagcgcaaagaagctacagcctggacttaccaccactaaactgcgagagaagctaaacgtgtttattttcccttaaattatttttgtaatggtagctttttctacatcttactcctgttgatgcagctaaggtacatttgtaaaaagaaaaaaaaccagacttttcagacaaaccctttgtattgtagataagaggaaaagactgagcatgctcacttttttatattaatttttacagtatttgtaagaataaagcagcatttgaaatcgaaaaaaaaaaaaaaaaaa

SEQ ID NO: 205 - DNA, 3647 bp, Homo sapiens
cacgcaacacctacgggtcgaatagagaagaaatgaagcacttcgcaggcatagttggagggagcggagcagggccgacagccagcggaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttcccaagaaatgcttcttttttaagttgacaaaaggaatggggaactggcaggccgcgcagaaggttcttggttttaatggataggctgaattggattaagaaaagttgaatgccacctatggtaatctatttgtgattttcttctaaattatgtattataaattcgtagagctatagaaagcaatgagtgtgtaatttggagtgattttatatatggcataaactttgttttaacataattagtactgttttcccccaaaagtacaagtttttgagtagcaatgtcaggttaagtaaagaaacttcatcacatcttataggtagtgtgtggccaattgacttaaaaaatacaaataacatttaggaagcaaatagattaaacacaaaaataaaactaaagcataggaattatgtttttgagatacctttgggcttagattggcattgttttattctaaaaacccaactcagtggtgtagagaaacttgtgtaccaaaattttagtttctgcagatgctagtgtttttttggatacaattttgacaaccaagttagtaaacaaaatatcttaacagtttgatgacacaagctactgatgagggtttggaatattaattcagaaggtagtttctcttgtgttcaaaatagctgccatggggctgttacttttaaagtcaaaattttcttctgaaggctcattttggtatttgatcttaaccaagtgattattagagaaatgtatcaactccatgccatctcccaaaataattgtctaagaaaacttgaaagtgtaaggttttaacctttaatttatttctcttaaatacatcttttgatattgttgttgtgacatttctttttctggttagtgggctttccagactttgtaccactgcttctgtttattcatttatatgcttttgtgtcccataaattatttcagaaaatgctgataaaactcaggatattgacatttttgttgagactaaaaaatggcagtcgctaaagtagggactctagagtctggcttacgtcagtgttggtagtttagattgtctttgtcaacgttttttcttctctcttttgctttcttttctttctctttttttcttagcacagttctagctcaaatttgtgtattttttgtgtgcctgggctggagatgagagactgagtcataactgatttaaaagtttgtgttatcaggtatcttatttgaacatggtcatttttggccacattgctgtttcatactaggacttgggatgatgtagccagaataaaactcaagttgcaccctccggttggtggaagattgctgaccgtgccgtttctgggcaggagaagacatcatggtgtccagcaactcagcaaagccattcttaagagtcgtgaggtccttctgaatgtaaaactggagcccaggagaagctgtcccaggagggctgttaactccctatagagccaggagacaggataggggtttctagggtccaacaccagcttaccttggagtatgaatctacccatgaaggatgagagatgttttgaaaaactagccaggacacacccacaggatcctactggctccttagcagctgattggtgttacataattaacttaattggagatgcattaggtcacttgaatgtataagcaagcacctatggtaggcgctacagacatttaaatctcttgggaattcgatgctcccatggaatttataccagttatatgaattgacttaagtatcttgaaaaagaaactttagagaaagcatcaggggtgtgtactcagtatttcaaatcagaacacaagattggaacttttggaaaaatgggttcaagctttcctattagccatggaaatgcaaagtttagcagaagcaagcaattaggcagagaacaaaaatgttaagcatggtgttgtctatcttattgaagtggttggaaatgaaagcttttaatttgatagatttatcagtataaaattagggaaaccacgtgtggggaatgaatcaatttagagcttcgggaattgtgaggtgacttttgtaacttttgttctgtgtgtgacctgtgaaccactaggatgtgatctgcccttgtgggcaggtccagcatagttaggagttaggctttagcataaatttctagctgcatctgagtctcctgggatgggtgctctttggctggttttggctgcggatggtgagatcagagcagctcttcctgctgctggcccctgcaatcagttgttgggatgccagtgcagatcactaagtagtaagattttaatcaaacacgaccaggtccgaaatgcaggtcatgagtgtgaaattctcaaatttacataaaaagtagaagtatagacagtttaacatttggtattaaaggagaggaaattgtagcagcttttcacgtttcccagtccccattagagggcttgagaccttgtacctgaacaacccattttgcactcagtgctttctgatgccttaggagaattgttttgtttcacaaaagctgggaaggaagaagtccattctgcagctgttagatctgcctctcaggaaaaagtactaacttgttctttttgttcctggctttcatcagtttgtgagatttctctattttttttaaatataattttatttctttcaacaaatataaaataaaaaacaactttggaacaatgaaaaaaaaaaaaaaa

SEQ ID NO: 206 - DNA, 3341 bp, Homo sapiens
tgagtttcacgcgcgtatgctttgcccgccatggccgcagtcaaggagcctttggagttccatgccaagcggccttggcgccccgaggaggcagtagaagatccggacgaggaggatgaggataatactagtgaagccgagaatgggttctccctggaggaagtgttacggctcggaggcaccaagcaagattaccttatgctggctactttggatgagaatgaggaagtgatagatggaggcaaaaaaggagcaatcgatgaccttcagcaaggtgaattggaagcatttattcaaaatcttaatttggcgaagtatacaaaagcttccttagttgaagaagatgaaccagctgaaaaagaaaattccagcaaaaaagaagtaaaaatacctaaaataaataataaaaatacagcagaaagtcaaaggacatcagttaataaggtgaaaaataagaataggccagaaccacattctgatgagaatggcagtaccacaccgaaagtaaagaaagataaacagaacatctttgaattttttgagagacagactttgttacttaggcctggaggcaaatggtatgatctggagtacagcaatgaatattctttgaaaccccagcctcaggatgttgtatctaagtacaaaacccttgctcagaagctgtatcagcatgaaatcaacttattcaaaagtaagacgaatagtcaaaagggagcctcttctacctggatgaaggcaattgtgtcatcggggacactaggtgacaggatggcagccatgattcttcttattcaggatgatgccgttcacacacttcagtttgtagaaactcttgtgaaccttgttaaaaagaagggcagcaaacagcagtgccttatggccttggatactttcaaagagttgcttatcacagaccttttgccagacaatcggaagctgaggattttcagccagcgtccttttgacaaactggaacagttgtccagtggcaacaaggactcaagagatagaagactgatattatggtattttgaacaccagctgaaacacttagtggctgaatttgtgcaggtcttagaaactttaagtcatgatacattagtaaccactaaaactcgagcccttaccgtggctcatgagctgctttgtaacaagcctgaggaagaaaaggctcttcttgtgcaagtggtaaataaactgggagatcctcagaacagaattgccacaaaagcatcccatctgttagagacattactttgtaaacatcccaatatgaaaggagttgtgtctggtgaagtagaaaggctactcttccgctcaaatatcagctccaaagctcaatattatgcaatttgctttttaaatcaaatggctctgtcccatgaagaaagtgaattggctaacaaattaataactgtttacttttgcttttttcggacttgtgtcaaaaaaaaagatgttgaatcaaaaatgcttagcgcccttttaacaggtgtgaatagggcatacccttattcccagactggtgatgacaaagtaagggagcagattgacacactgtttaaagtgttgcatattgtgaattttaataccagtgtccaggctttaatgttgcttttccaagtaatgaattctcagcagacaatatcggatcgatattacacagcattatacaggaagatgttggatccagggttgatgacgtgttccaagcaagctatgtttcttaaccttgtctacaaatctctgaaagctgacattgtgttgcgccgggtgaaggcttttgtgaagaggttacttcaagttacttgtcaacagatgccaccatttatatgtggagctttatatcttgtgtctgagatccttaaagcaaaaccaggtttaagaagccaactagatgatcatccggagtctgatgatgaagaaaattttattgatgcaaatgatgatgaagacatggaaaaattcactgatgcagacaaagaaacagagatagtgaaaaaacttgagacagaggaaacagttcctgaaactgatgtagaaaccaaaaaaccagaggttgcttcctgggtgcactttgataatttgaaaggtgggaaacagttaaataaatacgatccattcagtagaaaccctctgttctgtggagctgaaaatacaagtctttgggaactcaaaaagttatctgtgcattttcatccctccgtggccctttttgcaaagaccatccttcagggaaactatattcagtattcaggggacccactgcaggatttcactctaatgagatttttggatcgatttgtataccgaaatccaaagccccataaaggcaaagaaaacacagatagtgttgtgatgcagccgaaaagaaaacattttattaaggatattcgtcatcttcctgtgaacagtaaggagttccttgcaaaagaagaaagccaaataccagtggatgaagtgtttttccacaggtattataaaaaagttgctgttaaagagaaacaaaaacgggatgcagatgaagaaagtatagaagacgtggatgatgaagaatttgaagagctgattgacacatttgaagatgataactgtttcagctctggaaaggatgatatggattttgctggaaacgtgaaaaagagaacaaaaggagctaaggataacacattagatgaagattcagaaggtagtgatgatgaacttggtaacctggatgacgatgaagtttctttaggaagtatggatgatgaagaatttgctgaagttgatgaagatggaggaacattcatggatgtgttagatgatgaaagtgagagcgttccagaacttgaagtccactccaaagtcagtactaagaaaagcaagagaaaaggtacagatgattttgactttgctggctcatttcaagggccaagaaaaaagaaaagaaacttaaatgattccagcctatttgtatctgctgaagagtttggccatctattggatgaaaatatgggatccaagtttgataacattggcatgaatgccatggctaacaaagataatgcaagtctcaaacagcttagatgggaggctgaacgtgatgactggctacacaacagagatgcaaaaagtatcatcaagaaaaagaaacattttaaaaagaagaggattaaaaccactcaaaaaactaaaaaacaaaggaaatgagttattaatgtaaattatagattaaaattctacttacatctaatttttgctgttcaaccatgttttttgatctagctctctgattccatacattccagacttctcagtggatttgtaataaactataaataaaaaaaaaaaaaaaa

SEQ ID NO: 207 - DNA, 2108 bp, Homo sapiens
ctttcaattcctctggcaacaaaccacacactgggatctgacactgtagagtgctttctcttctctttttttgggggggggagggggtgtggttgcatatttaaactctcacgcatttatgtactgaggactgcagtgtaggactttcctgcagaataccatttgatcctattaagaattgtccaaatgttggagcatttgattgaaaaatccttcttagccattttaaagatagctttccaatgattagacgaattgattctttctgtgactcatcagttcatttcctgtaaaattcatgtcttgctgttgatttgtgaataagaaccagagcttgtagaaaccactttaatcatatccaggagtttgcaagaaacaggtgcttaacactaattcacctcctgaacaagaaaaatgggctgtgaccggaactgtgggctcatcgctggggctgtcattggtgctgtcctggctgtgtttggaggtattctaatgccagttggagacctgcttatccagaagacaattaaaaagcaagttgtcctcgaagaaggtacaattgcttttaaaaattgggttaaaacaggcacagaagtttacagacagttttggatctttgatgtgcaaaatccacaggaagtgatgatgaacagcagcaacattcaagttaagcaaagaggtccttatacgtacagagttcgttttctagccaaggaaaatgtaacccaggacgctgaggacaacacagtctctttcctgcagcccaatggtgccatcttcgaaccttcactatcagttggaacagaggctgacaacttcacagttctcaatctggctgtggcagctgcatcccatatctatcaaaatcaatttgttcaaatgatcctcaattcacttattaacaagtcaaaatcttctatgttccaagtcagaactttgagagaactgttatggggctatagggatccatttttgagtttggttccgtaccctgttactaccacagttggtctgttttatccttacaacaatactgcagatggagtttataaagttttcaatggaaaagataacataagtaaagttgccataatcgacacatataaaggtaaaaggaatctgtcctattgggaaagtcactgcgacatgattaatggtacagatgcagcctcatttccaccttttgttgagaaaagccaggtattgcagttcttttcttctgatatttgcaggtcaatctatgctgtatttgaatccgacgttaatctgaaaggaatccctgtgtatagatttgttcttccatccaaggcctttgcctctccagttgaaaacccagacaactattgtttctgcacagaaaaaattatctcaaaaaattgtacatcatatggtgtgctagacatcagcaaatgcaaagaagggagacctgtgtacatttcacttcctcattttctgtatgcaagtcctgatgtttcagaacctattgatggattaaacccaaatgaagaagaacataggacatacttggatattgaacctataactggattcactttacaatttgcaaaacggctgcaggtcaacctattggtcaagccatcagaaaaaattcaagtattaaagaatctgaagaggaactatattgtgcctattctttggcttaatgagactgggaccattggtgatgagaaggcaaacatgttcagaagtcaagtaactggaaaaataaacctccttggcctgatagaaatgatcttactcagtgttggtgtggtgatgtttgttgcttttatgatttcatattgtgcatgcagatcgaaaacaataaaataagtaagtatgtaccaaaaaatattgcttcaataatattagcttatatattacttgttttcactttatcaaagagaagttacatattaggccatatatatttctagacatgtctagccactgatcatttttaaatataggtaaataaacctataaatattatcacgcagatcactaaagtatatctttaattctgggagaaatgagataaaagatgtacttgtgaccattgtaacaatagcacaaataaagcacttgtgccaaagttgtccaaaaaa

SEQ ID NO: 208 - DNA, 3747 bp, Homo sapiens
aaatttttccgtctgccctttccccctcttctcgttggcagggttgatcctcattactgtttgctcaaacgtttagaagtgaatttaggtccctccccccaacttatgattttatagccaataggtgatgaggtttatttgcatatttccagtcacataagcagccttggcgtgaaaacagtgtcagactcgattccccctcttcctcctcctcaagggaaagctgcccacttctagctgccctgccatcccctttaaagggcgacttgctcagcgccaaaccgcggctccagccctctccagcctccggctcagccggctcatcagtcggtccgcgccttgcagctcctccagagggacgcgccccgagatggagagcaaagccctgctcgtgctgactctggccgtgtggctccagagtctgaccgcctcccgcggaggggtggccgccgccgaccaaagaagagattttatcgacatcgaaagtaaatttgccctaaggacccctgaagacacagctgaggacacttgccacctcattcccggagtagcagagtccgtggctacctgtcatttcaatcacagcagcaaaaccttcatggtgatccatggctggacggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggaggagtttaactaccctctggacaatgtccatctcttgggatacagccttggagcccatgctgctggcattgcaggaagtctgaccaataagaaagtcaacagaattactggcctcgatccagctggacctaactttgagtatgcagaagccccgagtcgtctttctcctgatgatgcagattttgtagacgtcttacacacattcaccagagggtcccctggtcgaagcattggaatccagaaaccagttgggcatgttgacatttacccgaatggaggtacttttcagccaggatgtaacattggagaagctatccgcgtgattgcagagagaggacttggagatgtggaccagctagtgaagtgctcccacgagcgctccattcatctcttcatcgactctctgttgaatgaagaaaatccaagtaaggcctacaggtgcagttccaaggaagcctttgagaaagggctctgcttgagttgtagaaagaaccgctgcaacaatctgggctatgagatcaataaagtcagagccaaaagaagcagcaaaatgtacctgaagactcgttctcagatgccctacaaagtcttccattaccaagtaaagattcatttttctgggactgagagtgaaacccataccaatcaggcctttgagatttctctgtatggcaccgtggccgagagtgagaacatcccattcactctgcctgaagtttccacaaataagacctactccttcctaatttacacagaggtagatattggagaactactcatgttgaagctcaaatggaagagtgattcatactttagctggtcagactggtggagcagtcccggcttcgccattcagaagatcagagtaaaagcaggagagactcagaaaaaggtgatcttctgttctagggagaaagtgtctcatttgcagaaaggaaaggcacctgcggtatttgtgaaatgccatgacaagtctctgaataagaagtcaggctgaaactgggcgaatctacagaacaaagaacggcatgtgaattctgtgaagaatgaagtggaggaagtaacttttacaaaacatacccagtgtttggggtgtttcaaaagtggattttcctgaatattaatcccagccctacccttgttagttattttaggagacagtctcaagcactaaaaagtggctaattcaatttatggggtatagtggccaaatagcacatcctccaacgttaaaagacagtggatcatgaaaagtgctgttttgtcctttgagaaagaaataattgtttgagcgcagagtaaaataaggctccttcatgtggcgtattgggccatagcctataattggttagaacctcctattttaattggaattctggatctttcggactgaggccttctcaaactttactctaagtctccaagaatacagaaaatgcttttccgcggcacgaatcagactcatctacacagcagtatgaatgatgttttagaatgattccctcttgctattggaatgtggtccagacgtcaaccaggaacatgtaacttggagagggacgaagaaagggtctgataaacacagaggttttaaacagtccctaccattggcctgcatcatgacaaagttacaaattcaaggagatataaaatctagatcaattaattcttaataggctttatcgtttattgcttaatccctctctcccccttcttttttgtctcaagattatattataataatgttctctgggtaggtgttgaaaatgagcctgtaatcctcagctgacacataatttgaatggtgcagaaaaaaaaaaagaaaccgtaattttattattagattctccaaatgattttcatcaatttaaaatcattcaatatctgacagttactcttcagttttaggcttaccttggtcatgcttcagttgtacttccagtgcgtctcttttgttcctggctttgacatgaaaagataggtttgagttcaaattttgcattgtgtgagcttctacagattttagacaaggaccgtttttactaagtaaaagggtggagaggttcctggggtggattcctaagcagtgcttgtaaaccatcgcgtgcaatgagccagatggagtaccatgagggttgctatttgttgtttttaacaactaatcaagagtgagtgaacaactatttataaactagatctcctatttttcagaatgctcttctacgtataaatatgaaatgataaagatgtcaaatatctcagaggctatagctgggaacccgactgtgaaagtatgtgatatctgaacacatactagaaagctctgcatgtgtgttgtccttcagcataattcggaagggaaaacagtcgatcaagggatgtattggaacatgtcggagtagaaattgttcctgatgtgccagaacttcgaccctttctctgagagagatgatcgtgcctataaatagtaggaccaatgttgtgattaacatcatcaggcttggaatgaattctctctaaaaataaaatgatgtatgatttgttgttggcatcccctttattaattcattaaatttctggatttgggttgtgacccagggtgcattaacttaaaagattcactaaagcagcacatagcactgggaactctggctccgaaaaactttgttatatatatcaaggatgttctggctttacattttatttattagctgtaaatacatgtgtggatgtgtaaatggagcttgtacatattggaaaggtcattgtggctatctgcatttataaatgtgtggtgctaactgtatgtgtctttatcagtgatggtctcacagagccaactcactcttatgaaatgggctttaacaaaacaagaaagaaacgtacttaactgtgtgaagaaatggaatcagcttttaataaaattgacaacattttattaccaca

SEQ ID NO: 209 - DNA, 1939 bp, Homo sapiens
aggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggacagtgccttggtaatgaccagggctccaggaagagatgtccttgtggctgggggcccctgtgcctgacattcctcctgactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacagagatccgtccacaaaagcggaaaaaggggccagcccccaaaatgctggggaacgagctatgcagcgtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacgccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtgatgcttctggagacatctcggaggtacaaccctgggagtgagagtatcaccttcctcaaggatttcagttataaccgggaagactttgccaaagcagggctgcaagtggaattcatcaaccccatcttcgagttctccagggccatgaatgagctgcaactcaatgatgccgagtttgccttgctcattgctatcagcatcttctctgcagaccggcccaacgtgcaggaccagctccaggtagagaggctgcagcacacatatgtggaagccctgcatgcctacgtctccatccaccatccccatgaccgactgatgttcccacggatgctaatgaaactggtgagcctccggaccctgagcagcgtccactcagagcaagtgtttgcactgcgtctgcaggacaaaaagctcccaccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggagatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcaaaaaaaaa

SEQ ID NO: 210 - DNA, 4922 bp, Homo sapiens
agcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgcccccccccccagcccctcccttcattcccattccccaacctaaagcctggcccggctcccagctgaatctggtcggaatccacgggctgcagattttccaaaacaatcgttgtatctttattgacttttttttttttttttttctgaatgcaatgactgttttttactcttaaggaaaataaacatcttttagaaacaaaaaaaaaaaa

SEQ ID NO: 211 - DNA, 2465 bp, Homo sapiens
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctctaaaaaaaaaaaa

SEQ ID NO: 212 - DNA, 1717 bp, Homo sapiens
atatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatgatgctccttggccaagtcaagtatgggttgcacaacatccagatcagccacttgtccatcgccagcagccaggtggagctggtggaagccaagtccattgatgtctccattcagaacgtgtctgtggtcttcaaggggaccctgaagtatggctacaccactgcctggtggctgggtattgatcagtccattgacttcgagatcgactctgccattgacctccagatcaacacacagctgacctgtgactctggtagagtgcggaccgatgcccctgactgctacctgtctttccataagctgctcctgcatctccaaggggagcgagagcctgggtggatcaagcagctgttcacaaatttcatctccttcaccctgaagctggtcctgaagggacagatctgcaaagagatcaacgtcatctctaacatcatggccgattttgtccagacaagggctgccagcatcctttcagatggagacattggggtggacatttccctgacaggtgatcccgtcatcacagcctcctacctggagtcccatcacaagggtcatttcatctacaagaatgtctcagaggacctccccctccccaccttctcgcccacactgctgggggactcccgcatgctgtacttctggttctctgagcgagtcttccactcgctggccaaggtagctttccaggatggccgcctcatgctcagcctgatgggagacgagttcaaggcagtgctggagacctggggcttcaacaccaaccaggaaatcttccaagaggttgtcggcggcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggatatcgtgactaccgtccaggcctcctattctaagaaaaagctcttcttaagcctcttggatttccagattacaccaaagactgtttccaacttgactgagagcagctccgagtccgtccagagcttcctgcagtcaatgatcaccgctgtgggcatccctgaggtcatgtctcggctcgaggtagtgtttacagccctcatgaacagcaaaggcgtgagcctcttcgacatcatcaaccctgagattatcactcgagatggcttcctgctgctgcagatggactttggcttccctgagcacctgctggtggatttcctccagagcttgagctagaagtctccaaggaggtcgggatggggcttgtagcagaaggcaagcaccaggctcacagctggaaccctggtgtctcctccagcgtggtggaagttgggttaggagtacggagatggagattggctcccaactcctccctatcctaaaggcccactggcattaaagtgctgtatccaag

SEQ ID NO: 213 - DNA, 8481 bp, Homo sapiens
gagagacggcagcggccccggcctccctctccgccgcgcttcagcctcccgctccgccgcgctccagcctcgctctccgccgcccgcaccgccgcccgcgccctcaccagagcagccatggaggaggtggtgattgccggcatgtccgggaagctgccagagtcggagaacttgcaggagttctgggacaacctcatcggcggtgtggacatggtcacggacgatgaccgtcgctggaaggcggggctctacggcctgccccggcggtccggcaagctgaaggacctgtctaggtttgatgcctccttcttcggagtccaccccaagcaggcacacacgatggaccctcagctgcggctgctgctggaagtcacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaatgtcctgctgaagcccaacacctccgtgcagttcttgaggctggggatgctcagccccgagggcacctgcaaggccttcgacacagcggggaatgggtactgccgctcggagggtgtggtggccgtcctgctgaccaagaagtccctggcccggcgggtgtacgccaccatcctgaacgccggcaccaatacagatggcttcaaggagcaaggcgtgaccttcccctcaggggatatccaggagcagctcatccgctcgttgtaccagtcggccggagtggcccctgagtcatttgaatacatcgaagcccacggcacaggcaccaaggtgggcgacccccaggagctgaatggcatcacccgagccctgtgcgccacccgccaggagccgctgctcatcggctccaccaagtccaacatggggcacccggagccagcctcggggctggcagccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacgtgcacatcatcctgaggcccaacacgcagccgccccccgcacccgccccacatgccaccctgccccgtctgctgcgggccagcggacgcacccctgaggccgtgcagaagctgctggagcagggcctccggcacagccaggacctggctttcctgagcatgctgaacgacatcgcggctgtccccgccaccgccatgcccttccgtggctacgctgtgctgggtggtgagcgcggtggcccagaggtgcagcaggtgcccgctggcgagcgcccgctctggttcatctgctctgggatgggcacacagtggcgcgggatggggctgagcctcatgcgcctggaccgcttccgagattccatcctacgctccgatgaggctgtgaagccattcggcctgaaggtgtcacagctgctgctgagcacagacgagagcacctttgatgacatcgtccattcgtttgtgagcctgactgccatccagataggcctcatagacctgctgagctgcatggggctgaggccagatggcatcgtcggccactccctgggggaggtggcctgtggctacgccgacggctgcctgtcccaggaggaggccgtcctcgctgcctactggaggggacagtgcatcaaagaagcccatctcccgccgggcgccatggcagccgtgggcttgtcctgggaggagtgtaaacagcgctgccccccgggcgtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcctccgccgagtacaatgtcaacaacctggtgagccctgtgctgttccaggaggccctgtggcacgtgcctgagcacgcggtggtgctggagatcgcgccccacgccctgctgcaggctgtcctgaagcgtggcctgaagccgagctgcaccatcatccccctgatgaagaaggatcacagggacaacctggagttcttcctggccggcatcggcaggctgcacctctcaggcatcgacgccaaccccaatgccttgttcccacctgtggagttcccagctccccgaggaactcccctcatctccccactcatcaagtgggaccacagcctggcctgggacgtgccggccgccgaggacttccccaacggttcaggttccccctcagccgccatctacaacatcgacaccagctccgagtctcctgaccactacctggtggaccacaccctcgacggtcgcgtcctcttccccgccactggctacctgagcatagtgtggaagacgctggcccgcgccctgggcctgggcgtcgagcagctgcctgtggtgtttgaggatgtggtgctgcaccaggccaccatcctgcccaagactgggacagtgtccctggaggtacggctcctggaggcctcccgtgccttcgaggtgtcagagaacggcaacctggtagtgagtgggaaggtgtaccagtgggatgaccctgaccccaggctcttcgaccacccggaaagccccacccccaaccccacggagcccctcttcctggcccaggctgaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctgcccacccgtgtcaccgccatccacatcgaccctgccacccacaggcagaagctgtacacactgcaggacaaggcccaagtggctgacgtggtggtgagcaggtggctgagggtcacagtggccggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttgtctgtgtttgtttttcaagaaatgattcaaattgctgcttggattttgaaatttactgtaactgtcagtgtacacgtctggaccccgtttcatttttacaccaatttggtaaaaatgctgctctcagcctcccacaattaaaccgcatgtgatctccaaaaaaaaaaaaaaaaaaaaaaaa

SEQ ID NO: 214 - DNA, 2520 bp, Homo sapiens
ggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaa

SEQ ID NO: 215 - DNA, 1257 bp, Homo sapiens
ctggggagagtatatactgaatttagcttctgagacatgatgctcttcctttttaattaacccagaacttagcagcttatctatttctctaatctcaaaacatccttaaactgggggtgatacttgagtgagagaattttgcaggtattaaatgaactatcttcttttttttttttctttgagacagagtcttgctctgtcacccaggctggagtgcagtggcgtgatctcagctcactgcaacctccgcctcccgggttcaagtgattctcctgcctcagcctcctgagtagctgggattacagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 216 - DNA, 5190 bp, Homo sapiens
tctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaaaaaaaaaaaaaaaa

SEQ ID NO: 217 - DNA, 2949 bp, Homo sapiens
agtttcccgaccagagagaacgaacgtgtctgcgggcgcgcggggagcagaggcggtggcgggcggcggcggcaccgggagccgccgagtgaccctcccccgcccctctggccccccaccctcccacccgcccgtggcccgcgcccatggccgcgcgcgctccacacaactcaccggagtccgcgccttgcgccgccgaccagttcgcagctccgcgccacggcagccagtctcacctggcggcaccgcccgcccaccgccccggccacagcccctgcgcccacggcagcactcgaggcgaccgcgacagtggtgggggacgctgctgagtggaagagagcgcagcccggccaccggacctacttactcgccttgctgattgtctatttttgcgtttacaacttttctaagaacttttgtatacaaaggaactttttaaaaaagacgcttccaagttatatttaatccaaagaagaaggatctcggccaatttggggttttgggttttggcttcgtttcttctcttcgttgactttggggttcaggtgccccagctgcttcgggctgccgaggaccttctgggcccccacattaatgaggcagccacctggcgagtctgacatggctgtcagcgacgcgctgctcccatctttctccacgttcgcgtctggcccggcgggaagggagaagacactgcgtcaagcaggtgccccgaataaccgctggcgggaggagctctcccacatgaagcgacttcccccagtgcttcccggccgcccctatgacctggcggcggcgaccgtggccacagacctggagagcggcggagccggtgcggcttgcggcggtagcaacctggcgcccctacctcggagagagaccgaggagttcaacgatctcctggacctggactttattctctccaattcgctgacccatcctccggagtcagtggccgccaccgtgtcctcgtcagcgtcagcctcctcttcgtcgtcgccgtcgagcagcggccctgccagcgcgccctccacctgcagcttcacctatccgatccgggccgggaacgacccgggcgtggcgccgggcggcacgggcggaggcctcctctatggcagggagtccgctccccctccgacggctcccttcaacctggcggacatcaacgacgtgagcccctcgggcggcttcgtggccgagctcctgcggccagaattggacccggtgtacattccgccgcagcagccgcagccgccaggtggcgggctgatgggcaagttcgtgctgaaggcgtcgctgagcgcccctggcagcgagtacggcagcccgtcggtcatcagcgtcagcaaaggcagccctgacggcagccacccggtggtggtggcgccctacaacggcgggccgccgcgcacgtgccccaagatcaagcaggaggcggtctcttcgtgcacccacttgggcgctggaccccctctcagcaatggccaccggccggctgcacacgacttccccctggggcggcagctccccagcaggactaccccgaccctgggtcttgaggaagtgctgagcagcagggactgtcaccctgccctgccgcttcctcccggcttccatccccacccggggcccaattacccatccttcctgcccgatcagatgcagccgcaagtcccgccgctccattaccaagagctcatgccacccggttcctgcatgccagaggagcccaagccaaagaggggaagacgatcgtggccccggaaaaggaccgccacccacacttgtgattacgcgggctgcggcaaaacctacacaaagagttcccatctcaaggcacacctgcgaacccacacaggtgagaaaccttaccactgtgactgggacggctgtggatggaaattcgcccgctcagatgaactgaccaggcactaccgtaaacacacggggcaccgcccgttccagtgccaaaaatgcgaccgagcattttccaggtcggaccacctcgccttacacatgaagaggcatttttaaatcccagacagtggatatgacccacactgccagaagagaattcagtattttttacttttcacactgtcttcccgatgagggaaggagcccagccagaaagcactacaatcatggtcaagttcccaactgagtcatcttgtgagtggataatcaggaaaaatgaggaatccaaaagacaaaaatcaaagaacagatggggtctgtgactggatcttctatcattccaattctaaatccgacttgaatattcctggacttacaaaatgccaagggggtgactggaagttgtggatatcagggtataaattatatccgtgagttgggggagggaagaccagaattcccttgaattgtgtattgatgcaatataagcataaaagatcaccttgtattctctttaccttctaaaagccattattatgatgttagaagaagaggaagaaattcaggtacagaaaacatgtttaaatagcctaaatgatggtgcttggtgagtcttggttctaaaggtaccaaacaaggaagccaaagttttcaaactgctgcatactttgacaaggaaaatctatatttgtcttccgatcaacatttatgacctaagtcaggtaatatacctggtttacttctttagcatttttatgcagacagtctgttatgcactgtggtttcagatgtgcaataatttgtacaatggtttattcccaagtatgccttaagcagaacaaatgtgtttttctatatagttccttgccttaataaatatgtaatataaatttaagcaaacgtctattttgtatatttgtaaactacaaagtaaaatgaacattttgtggagtttgtattttgcatactcaaggtgagaattaagttttaaataaacctataatattttatctgaaaaaaaaaaaaaaaaaa

SEQ ID NO: 218 - DNA, 2098 bp, Homo sapiens
attataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacat

SEQ ID NO: 219 - DNA, 2264 bp, Homo sapiens
agtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaaaaaaaaaaaaaaaaaaa

SEQ ID NO: 220 - DNA, 2651 bp, Mus musculus
attcgcgacccgaagctgcgcgggcgcgagccagttggggcactgggtgggcggcggcgacagcggcgccacgcgcaggctggaggccgccgaggctcgccatgccgggagaactctaactcccccatggagtcggccgacttctacgaggtggagccgcggcccccgatgagcagtcacctccagagccccccgcacgcgcccagcaacgccgcctttggctttccccggggcgcgggccccgcgccgcccccagccccacctgccgccccggagccgctgggcggcatctgcgagcacgagacgtctatagacatcagcgcctacatcgacccggccgccttcaacgacgagttcctggccgacctcttccagcacagccgacagcaggagaaggccaaggcggcggcgggccccgcgggtggcggcggtgactttgactacccgggagccccggcgggccccggcggcgcggtcatgtccgcgggggcgcacgggccccctcccggctacggctgtgcggcggccggctacctggacggcaggctggagcccctgtacgagcgcgtcggggcgcccgcgctacggccgctggtgatcaaacaagagccccgcgaggaggacgaggcgaagcagctggcgctggccggcctcttcccctaccagccaccgccgccaccgccaccgccgcacccgcacgcgtctcccgcgcacctggccgccccccacttgcagttccagatcgcgcactgcggccagaccaccatgcacctgcagcctggccaccccacaccgccgcccacgcccgtgcccagcccgcacgctgcgcccgccttgggtgctgcgggcctgcctggccccgggagcgcgctcaagggcttggccggtgcgcaccccgacctccgcacgggaggcggcggcggtggcagcggtgccggtgcgggcaaagccaagaagtcggtggacaagaacagcaacgagtaccgggtacggcgggaacgcaacaacatcgcggtgcgcaagagccgagataaagccaaacaacgcaacgtggagacgcaacagaaggtgctggagttgaccagtgacaatgaccgcctgcgcaagcgggtggaacagctgagccgtgaactggacacgctgcggggcatcttccgccagctgcctgagagctccttggtcaaggccatgggcaactgcgcgtgaggcgcgcggctgcgggaccgccttgggccggccccctggctggagacccagaggatggtttcgggtcgctggatctctaggctgcccgggccgcgcaagccaggactaggagattccggtgtggcctgaaagcctggcctgctccgcgtgtcccctcccttcctctgagccggactcggtgcgtctaagatgagggagtcaggccgtggtggtttctccttgagaccgagagactttccgcggagctgagctgggggcccggcagtactagtattaaggaagtaaccttgtgccttggatactcaaaactcgctccttttcctaccgagtagggggagcaaaaatgtgccttgatattttatttggaggattcctgcttcctctcgggcctcagctggccccgtgagaaaaatgaagggtgcaggcccagggcaggaggaagatacaggaagctgagatcccggcagtgccctgagctgcccctcagtccctgtctttagaggggagggacttaggtgttggggatttgagtctgtgtcctcacccccagctacagggaggtggagggctcctaatcccttgctttttgcacctccacctacatccccccccccccactcagcttacaacaggccaggtttcctgggtgagttcatggagaatgggggcaccacccccagtcagaccagaaagctgagttgtgagttagccatgtggtaggagacagagacctaggtttctgggctttgtggggtgggggataggaggacacggggaccattagccttgtgtgtactgtatgtcgccagccgctgttgctgaaggaacttgaagcacaatcgatccatcccagagggactggagttatgacaagcttcccaaatattttgctttatcatccgatatcaacacttgtatctggtctctgtgtcccagcggtgccttgtgcaatggcagtgtgcacgtctatgctaaaccaccattttatttggtcttttgttttgttttggttttgctctgattcttgccaaactgagactcttcactaacggctgggggaaggagctgagtgaggctctcattctttttggtttagggatgtttgggttttttcgtctgcctcccagaggaccaatgaaatgaagtgggcttccccctctcccctagttgtccaagggtgtatgtagtagtgggtcttagcttcctccggctaagacttaggcttccccacccacccaaccccatccccaacggccctggctctgggtctggaaagaaggccacctccagccagttcatacacacacccctgtggctgggagcagggctggaccgcttccttctcttcttttttttgggggggggggacacaaagtttcatgctagatgtcgtatgtattatatctataatataaacatatcaaactcaaaaaaaaaaaaaaaaa

SEQ ID NO: 221 - DNA, 3539 bp, Mus musculus
tcaaatgtaggtgatgggtcttcaccagaaatagacccttgtgagcttaactagcagtgaagtgtgacttttttctttctcttctttttttcaattcccttggcaaccaaccacaaattagcatctgacattgaattttttaaagctcgtttcaactctcacacacataagtagtgaggaattcagggtaggggttttctactgaggactttttcttcttcacagctgccttctgaaatgtgtggagcaactggtggatggtttcctagcctttcaaaggtagtttacaaatgatttgaagtgctgatcctttcagagtctcaacagattatttcttaaacagctcatacattgctgtttatgcatgaattagaaccgggccacgtagaaaacactgtgattgtacctgggagttggcgagaaaaccagtgctctcccttgattctgctgcacgaggagaatgggctgtgatcggaactgtgggctcattgctggagctgttattggtgcagtcctggctgtgtttggaggcattctcatgccagtcggagacatgcttattgagaagacaatcaaaagggaagttgtccttgaagaaggaaccactgctttcaaaaactgggttaaaacaggcaccactgtgtacagacagttttggatctttgatgtgcaaaacccagatgacgtggcaaagaacagcagcaaaatcaaggttaaacaaagaggtccttacacatacagagttcgttatctagccaaggaaaatataactcaggaccccgaggaccacactgtgtcttttgtacagcccaatggagccatctttgagccttcactgtctgttggaacagaggatgacaacttcacagttctgaatctggctgtagcagctgcaccacatatctaccaaaattcatttgttcaagttgtgctcaactctcttataaaaaagtccaagtcttctatgttccaaacaagatctttgaaagaactcttgtggggttacaaagatccattcctcagtttggttccatatcctataagtaccacagttggtgtgttttatccttacaatgacactgtagatggagtttataaagttttcaatggaaaggataacataagcaaagttgccataattgagtcctataaagggaaaaggaatttgtcctattggccaagctattgcgacatgattaatggcacagacgcagcctcctttccaccttttgttgaaaagtctcggacattgagattcttttcctctgacatttgcaggtctatctacgctgtgttcggatctgaaatcgaccttaaaggaatccccgtgtacagatttgttcttccagccaatgcctttgcatcacccctccagaatccagacaaccattgtttctgcactgaaaaagtaatctccaataactgtacatcttatggtgtgctagacattggcaaatgcaaagaaggaaagcctgtgtatatttcgcttccacatttcctacatgcaagtccagatgtttcagaacctattgaaggcttacatccaaatgaagatgagcataggacatacttagatgtggaacccataactggattcactctacaatttgcaaaacgactgcaggtcaacatattggtcaagccagctagaaaaatagaagcattaaagaatctgaagagaccttacattgtacctatactgtggctaaatgagactgggaccattggtgatgaaaaagcagaaatgttcaaaacacaagtgactgggaaaatcaagctccttggcatggtagagatggccttacttgggattggagtggtgatgtttgttgcttttatgatttcatattgtgcttgcaaatccaagaatggaaaataagtagtggatgagcctacatatacactggctacatctttggtaaagccgatctacaaaatgaaaacttaatatatgcttcgtttttacaaaacacacctatctttaggagaagaaatggtggtgtgtgctctctctctctttctctttctctcttattgcagatatatatttatttgtaaatatatatatatgcaataagtcacagcatatttcaaaagattaatatgtcactataggcaatattttttaataaaatcttgcacttttattaaaagtccatcatttgcaactgagtggacttcaatttctgtagacccaattatcctgtttggttctgatttactgatttgttccatgttggcaaatttcaagaatgtacattctgagaaatttttgttttccctcactggaggaaactgctatcatgactggggtggcccctttgtttatagcaaatttggcttgcaactgtcagcacatggcataagtataacatcttgaaagacttaagaatgaaaaatgaacaattcacatgtgagccactgcttatatattaagtctctccctctctggagttcttggctacagcaaggccagatatcacattggttttggttttgttgtttttgttttgtttttgttttttactctctgacacagagcttatgaaatggacttttttttttttttttagcataccttagctctttgtattttaagtatgtcgtcatgttccatgctgcatagctctttaaaaaacctgagtaggtttttctctttctgctcagctgcaactaataacaaccttggagagctgttatagtgttaaaagatgtaaatgataataaaagaattattaaatggaatcctacaaaagcaacaatgggctttaatatatatttgtggtaatatctcctgctttcataatcacccaaaaaaaggactggtttctaacattaaaagaagtcgttccttaaattcaacctttttgtctagttactattgaatcacagtatgttatttattgtattttattttgttttttgtagaagtgttctatctgagattctgtgtccttctgaatcatttaacctttctgctatgtcttaatgcaattgaacacagatattttgttataattttatagcagcagtgtgagactgaaggcaaatattttccagggtaagacacagtgataggttgttctacttcctttagcagcataatcaatttcacttagtattagtcccaataaattctggtataagacacaaaataaaaacaaacattttctgttctatacgtagaaaaataaaaggaaaggtgagacaactaactctcttgtctagatataaaaataatcaaaactgcatggcagctttgggcaggagtgctggattagtggttaggagtcatcaatgttcctacagaagacctgggcttggtacccagcttctatacgtctgctcacagcctcatatgattcctgtcagttgatactatgcccgcctctcctgtgcacccttctgcactgcatgtggtgatcatttatacactcaggtatgcatgcacacatggaatttaaagaggctggaagagtgtatgagaaggttgtagaggagaaaggagtgtgggaaacgatgtcattaaaatcagattt

SEQ ID NO: 222 - DNA, 4049 bp, Mus musculus
gtcagactctcgatttctcctcctactcctcctccgaggaattctgccccttgtaactgttctgccctcccctttaaaggttgacttgccctacggcgctccaccgcgctccagtcctcttgcgcctcctgctcaacccgctcctgactgccccacgccgcgtagttccagcagcaaagcagaagggtgcaccgggagatggagagcaaagccctgctcctggtggtcctgggagtttggctccagagtttgaccgccttccgaggaggggtggccgcagcagacgcgggaagagatttctcagacatcgaaagcaaatttgccctaaggacccctgaagacacagctgaggacacttgtcatctcattcctggattagcagactctgtgtctaactgccacttcaaccacagcagcaagaccttcgtggtgatccatggatggacggtaacgggaatgtatgagagttgggtgcccaaacttgtggccgccctgtacaagagagaacctgactccaatgtcattgtagtagactggttgtatcgggcccagcaacattatccagtgtcagctggctacaccaagctggtgggaaatgatgtggccagattcatcaactggatggaggaggagtttaactaccccctagacaacgtccacctcttagggtacagccttggagcccatgctgctggcgtagcaggaagtctgaccaataagaaggtcaatagaattactggtttggatccagctgggcctaactttgagtatgcagaagcccccagtcgcctttctcctgatgacgctgattttgtagatgtcttacacacatttaccagggggtcacctggtcgaagtattggaatccagaaaccagtagggcatgttgacatttatcccaatggaggcactttccagccaggatgcaacattggagaagccatccgtgtgattgcagagagaggactcggagacgtggaccagctggtgaagtgctcgcacgagcgctccattcatctcttcattgactccctgctgaatgaagaaaaccccagcaaggcatacaggtgcaactccaaggaagcctttgagaaagggctctgcctgagttgtagaaagaatcgctgtaacaatctgggctatgagatcaacaaggtcagagccaagagaagcagcaagatgtacctgaagactcgctctcagatgccctacaaagtgttccattaccaagtcaagattcacttttctgggactgaggatggcaagcaacacaaccaggccttcgagatttctctgtacggcacagtggccgagagcgagaacattcccttcaccctgcccgaggtttccacaaataaaacctactccttcttgatttacacggaggtggacatcggagaactgctcatgatgaagcttaagtggataagcgactcctacttcagctggcctgactggtggagcagccccagcttcgtcatcgagaggatccgagtgaaagccggagagactcagaaaaaggtcatcttctgtgctagggagaaagtttctcatctgcagaagggaaaggactcagcagtgtttgtgaaatgccatgacaagtctctgaagaagtctggctgacactggacaaacaaacaagagaagaaagcatctgagttctttgaagacagaagaaaacaaagtaaatttaatttaaaaaaataatacccttgtttgggtgtttgaaagtgggttttcctgagtattaatcccagctctatcttgttagttaaacagaagacagtctcaaatattaaacggtggctaacccagggtgaggaatctaatggcccatagcaggtcttccagcattagaagacagcaggcaggagaaacatgctgtcttgtatcccttaagaaggaatcatttgctcccaacaatataagactccatcatgtgacccatttggtcatggtctaaaattagtaagaactctgaggttttatattgagaccttttcaaagttttctcaaagtctaatatagacaatattttttgtggcataagtcaggtccatttctttagtgattgaaacacctggcctttgcaactagtttttttaccattgggatatattccccccaccaaaaaaaaaaaaaaaaaaaaagtaaccaggaacgtgtgacttggcaaaagcagttgaagacatggctcatgaagtcctgacccttggtcccaccacaacaaagtacaagtcaacagagatacaaaacctagactgagtaattcttaatagacttgaatttttatgacttaatccttctatcttttaaatatttgtcagatattttaacattgttctctggagcttgtaagctgggcaatggtggcactcacctttaatcccagcacttggcaggcagaggcaggaggatttctgagttcaaggccagcctggtttacagagtgagttccaggacgtccagagctacacagagaaaccctgtcttgggaaaaaaaaaagaagaagaaggagaagaagaagagggagggagggagggagggagggagggagggagggagggagggagggagggagggagggagggagggagaaggaaggaaggaaggaaggaaggaaggaaggaaggaaggaaggaaggaaggaaggaaggaaggaaggaaagaaagaaagaaagaaagaaagaaagaaagaaagaaagaaagaaagaaagaaagaaagaaagaaagaaagaaagaaagaaagaaagaaagaaagaaagaaagaaagaaaatgagcttgtaattgaggtgacacataaattttgctgaaagacaaaaatgcctaggttgattttacttcttctcttttttgctttcttgaaaaaagtcacaattgtcccatgctgtaaccaagtctggcctcgaactaaactatgtatttcaggctggccttgaactctcaaccatcctgccttagcttcctgtgtcctgggagcttgagaactgtaattttattatcagatttttcttacttgttttcatcaatttgaaatgcccaatatccaatactttgtatttcatttgagactcatctccgccatgcctctgtcacacttctaacacatcacattaatttctagtttagatgtgatcaagttcaaattctgcactgtgcaaagtacaagttttagagcaggaccatttttttttatcacataaaagttgaaattactagaaaatgtgcatatggatgcttgtaaactgctgtgcaaagagaagagccctcaactgtaatagctatagaaagtaccaggattgttgccgctgttttgttttaccttaacaacaacaacaacaaaaatcaataatgaagaattatttatgaacgagatctcacattttcagattgcttttattattcattaatgtaaaatgataaagaagatctatctcagaggctatagctgggagcagaaactgtgaaatttgtgggtatctgaacaccaacccacatgcaaagccccacaagtgtagtcgtcattcaatgtgattcagaaaggaaagagtcaagggatatactggaatatgttagagaagtagttccagatatgctggaatgttagcccttgctaggagaaagctggttgtgcctatgtaatataggacaaaggtgaccgatttcatcaagtttggagtcaattctaacaataaaaatatgtataatttgtcaccggcatccccattattgctaattcattacagtatatacacatccatgcatacatatgtcaatgatgctttagctttcaatttatttattagctgtaaataatgtgtgggtatgtaagaatgcttgtaaacactggaaagtctgttgtggttatctgcagtatagatttgtggtgctaactttgtgtccgtctccatccatgattgtctgtctcactgagccaacttaactctgatgaaacagtacaatgaaataggcttttgaaagaagaaaactcacctgtgtgaagaaatggtatctgctttcaataaaactgagaacattttatcatga

SEQ ID NO: 223 - DNA, 1955 bp, Mus musculus
agggtgaggagaggaaggagagagatggaactagaccggtctgcggggaaacgcgacagttttggtagagggtaggggacagggtggcgccggctaagagggtggccggccggggaggagttagtctggtggggaagctacctcgtgggcgggggcctaatgaagctaagagtcttgggtcgccagtaggaaggaccccttggcagtccctccccttggccttttcctacattactgcttctccctgctggcccctgtgcgctcagctcttgtcactggctgcccgctgcggcctcgaaggccaggacagtgtcttggtaatgtccagggctccaggaagagatgtccttgtggctggaggcctcaatgcctgatgtttctcctgattctgcaacggagttgtggaagacagaacctcaagatgcaggagaccagggaggcaacacttgcatcctcagggaggaagccaggatgccccagtcaactggggttgctttagggatagggttggagtcagcagagcctacagccctgctccccagggcagagaccctcccagagccgacagagcttcgtccacaaaagcggaaaaagggcccagcccccaaaatgctggggaacgagctgtgcagtgtctgtggggacaaagcctctggcttccattacaacgtgctgagctgcgagggctgcaagggattcttccgccgcagtgtcatcaagggagcacgctatgtctgccacagcggtggccactgccccatggacacctacatgcggcggaaatgccaggagtgtcgacttcgcaaatgccgccaggcaggcatgagggaggagtgtgtgctgtcagaagaacagatccgcttgaagaaactgaagcggcaagaagaggaacaggctcaagccacttcggtgtccccaagggtgtcctcacctcctcaagtcctgccacagctcagcccagagcagctgggcatgatcgagaagctggtggctgcccagcaacagtgtaacaggcgctccttctcagaccgcctgcgcgtcacgccttggcccattgcacccgaccctcagagccgggaagcccgacaacagcgctttgcccactttactgagctggccatcgtgtccgtgcaggagattgttgactttgccaaacagctccctggcttcctacagctcagcagggaggaccagatcgccttgctgaagacctctgcaatcgaggtcatgcttctggagacgtcacggaggtacaaccccggcagtgagagcatcaccttcctcaaggacttcagttacaaccgggaagactttgccaaagcagggctgcaggtggagttcatcaaccccatctttgagttctccagagccatgaatgagctgcaactcaatgatgctgagtttgctctgctcattgccatcagcatcttctctgcagaccggcccaacgtgcaggaccagctccaagtagagaggctgcaacacacatatgtggaggccctgcacgcctacgtctccatcaaccacccccacgacccactgatgttcccacggatgctaatgaagctggtgagcctccgtactttgagcagcgtccattcagagcaagtgtttgcccttcgcctgcaggacaaaaagcttccccctctgctgtctgagatctgggatgtccacgagtgactgtttcaccgtgtcctttgtgttggccacatggcgaaggctcactgactgcttcccacgggtggagcagactgagaagggcagacattcctgggagctgggtgaaggagagagccttgcgtagcattaagggagagtcaacaggttgggtgttttctggctgctgggcagttgggatctactaacgttgtataccatctgaagaccttgttgacccaaccaaataaactagccaggagagccactttgtgcagggttcttcagggccccgccca

SEQ ID NO: 224 - DNA, 4299 bp, Mus musculus
agtttccggggaacttttccttaacgtgggcctagtccgaagccgggtgggcgccggcgccatggacgagctggccttcggtgaggcggctctggaacagacactggccgagatgtgcgaactggacacagcggttttgaacgacatcgaagacatgctccagctcatcaacaaccaagacagtgacttcccgggcctgtttgacgccccctatgctgggggtgagacaggggacacaggccccagcagcccaggtgccaactctcctgagagcttctcttctgcttctctggcctcctctctggaagccttcctgggaggacccaaggtgacacctgcacccttgtcccctccaccatcggcacccgctgctttaaagatgtacccgtccgtgtcccccttttcccctgggcctgggatcaaagaggagccagtgccactcaccatcctacagcctgcagcgccacagccgtcaccggggaccctcctgcctccgagcttccccgcaccacccgtacagctcagccctgcgcccgtgctgggttactcgagcctgccttcaggcttctcagggacccttccaggaaacactcagcagccaccatctagcctgccgctggcccctgcaccaggagtcttgcccacccctgccctgcacacccaggtccaaagcttggcctcccagcagccgctgccagcctcagcagcccctagaacaaacactgtgacctcacaggtccagcaggtcccagttgtactgcagccacacttcatcaaggcagactcactgctgctgacagctgtgaagacagatgcaggagccaccgtgaagactgcaggcatcagcaccctggctcctggcacagccgtgcaggcaggtcccctgcagaccctggtgagtggagggaccatcttggccacagtacctttggttgtggacacagacaaactgcccatccaccgactcgcagctggcagcaaggccctaggctcagctcagagccgtggtgagaagcgcacagcccacaatgccattgagaagcgctaccggtcttctatcaatgacaagattgtggagctcaaagacctggtggtgggcactgaagcaaagctgaataaatctgctgtcttgcgcaaggccatcgactacatccgcttcttgcagcacagcaaccagaagctcaagcaggagaacctgaccctacgaagtgcacacaaaagcaaatcactgaaggacctggtgtcagcttgtggcagtggaggaggcacagatgtgtctatggagggcatgaaacccgaagtggtggagacgcttacccctccaccctcagacgccggctcaccctcccagagtagccccttgtcttttggcagcagagctagcagcagtggtggtagtgactctgagcccgacagtccagcctttgaggatagccaggtcaaagcccagcggctgccttcacacagccgaggcatgctggaccgctcccgcctggccctgtgtgtactggcctttctgtgtctgacctgcaatcctttggcctcgcttttcggctggggcattctcactccctctgatgctacgggtacacaccgtagttctgggcgcagcatgctggaggcagagagcagagatggctctaattggacccagtggttgctgccacccctagtctggctggccaatggactactagtgttggcctgcttggctcttctctttgtctatggggaacctgtgactaggccacactctggcccggctgtacacttctggagacatcgcaaacaagctgacctggatttggcccggggagatttcccccaggctgctcaacagctgtggctggccctgcaagcgctgggccggcccctgcccacctcaaacctggatctggcctgcagtctgctttggaacctcatccgccacctgctccagcgtctctgggtgggccgctggctggcaggccaggccgggggcctgctgagggaccgtgggctgaggaaggatgcccgtgccagtgcccgggatgcggctgttgtctaccataagctgcaccagctgcatgccatgggcaagtacacaggaggacatcttgctgcttctaacctggcactaagtgccctcaacctggctgagtgcgcaggagatgctatctccatggcaacactggcagagatctatgtggcagcggccctgagggtcaaaaccagcctcccaagagccctgcacttcttgacacgtttcttcctgagcagcgcccgccaggcctgcctagcacagagcggctcggtgcctcttgccatgcagtggctctgccaccctgtaggtcaccgtttctttgtggacggggactgggccgtgcacggtgcccccccggagagcctgtacagcgtggctgggaacccagtggatccgctggcccaggtgacccggctattccgtgaacatctcctagagcgagcgttgaactgtattgctcagcccagcccaggggcagctgacggagacagggagttctcagatgcccttggatatctgcagttgctaaatagctgttctgatgctgccggggctcctgcttgcagtttctctgtcagctccagcatggctgccaccactggcccagacccagtggccaagtggtgggcctcactgacagctgtggtgatccactggctgaggcgggatgaagaggcagctgagcgcttgtacccactggtagagcatatcccccaggtgctgcaggacactgagagacccctgcccagggcagctctgtactccttcaaggctgcccgggctctgctggaccacagaaaggtggaatctagcccagccagcctggccatctgtgagaaggccagtgggtacctgcgggacagcttagcctctacaccaactggcagttccattgacaaggccatgcagctgctcctgtgtgatctacttcttgtggcccgtaccagtctgtggcagcggcagcagtcaccagcttcagtccaggtagctcacggtaccagcaatggaccccaggcctctgctctggagctgcgtggtttccaacatgacctgagcagcctgcggcggttggcacagagcttccggcctgctatgaggagggtattcctacatgaggccacagctcggctgatggcaggagcaagtcctgcccggacacaccagctcctggatcgcagtctgaggaggagggcaggttccagtggcaaaggaggcactacagctgagctggagccacggcccacatggcgggagcacaccgaggccctgctgttggcatcctgctatctgccccctgccttcctgtcggctcctgggcagcgaatgagcatgctggccgaggcggcacgcaccgtagagaagcttggcgatcaccggctactgctggactgccagcagatgctcctgcgcctgggcggcggaaccaccgtcacttccagctagaccccaaagctttcccttgaggacctttgtcattggctgtggtcttccagagggtgagcctgacaagcaatcaggaccatgccgacctctagtggcagatctggaaattgcagaggctgcactggcccgatggcaccctcttgctctgtaggcaccttagtggcttttccctagctgaggctcaccctgggagacctgtacatagtgtagatccggctgggcctggctccagggcaggcccatgtactactttgacttttgcaaactttattttcataggttgagaaattttgtacagaatattaaaaaatgaaattatttataacttcagttttgtttatctgggtaggcagatgtctgcctcagctgattgctatctttcctggcttgtcctttgggaagccggacttcccatctgttgtaaggtgtatttgctggcttggtgatgctatgttgagccaccttggccctctgatctcatggctcataacccttgaggggccttgatggtctcagttgttcctttgccttccagccctccaccaggtaataaccccgtatatccagaaacacacacagttccctagtcatctctgtgcaccagcataggcgaaggatcagggcccattagtgagtagactgggaaccctgtttgtgtcccccggccccttccctctactcccaaccccttagggaatctggtcggcatccacaggccgcacacttccaaaacaatcgtggtatctttattgacttttttttttctgaatgcaatgactgttttttttttttttaactcttaaggaaaataaacatcttttagaaacagctcg

SEQ ID NO: 225 - DNA, 2251 bp, Mus musculus
ccgcgcttcgctggctttctgctcatctagggtggcagcggctacctacctcagctctcgccctgctgccgccacggcctgggcgctgtccctcagctcccggagctcagcgcgaagccctggccccggcggccggggcatgggtcaggggcgcggcgtgaggcggctttctgcacggccgtgacgtgcattggcttcagcatgaagaccctcatcgccgcctactccggggtcctgcggggtgagcgtcgggcggaagctgcccgcagcgaaaacaagaataaaggatctgccctgtcacgcgaggggtctgggcgatggggcactggctccagcatcctctcagccctccaagacatcttctctgtcacctggctcaacagatctaaggtggaaaaacagctgcaggtcatctcagtactacaatgggtcctatccttcctggtgctaggagtggcctgcagtgtcatcctcatgtacaccttctgcacagactgctggctgatagctgtgctctacttcacctggctggcatttgactggaacacgcccaagaaaggtggcaggagatcgcagtgggtgcgaaactgggccgtgtggcgctacttccgagactactttcccatccagctggtgaagacacacaacctgctgaccaccaggaactatatctttggataccacccccatggcatcatgggcctgggtgccttctgtaacttcagcacagaggctactgaagtcagcaagaagtttcctggcataaggccctatttggctacgttggctggtaacttccggatgcctgtgcttcgcgagtacctgatgtctggaggcatctgccctgtcaaccgagacaccatagactacttgctctccaagaatgggagtggcaatgctatcatcatcgtggtgggaggtgcagctgagtccctgagctccatgcctggcaagaacgcagtcaccctgaagaaccgcaaaggctttgtgaagctggccctgcgccatggagctgatctggttcccacttattcctttggagagaatgaggtatacaagcaggtgatctttgaggagggttcctggggccgatgggtccagaagaagttccagaagtatattggtttcgccccctgcatcttccatggccgaggcctcttctcctctgacacctgggggctggtgccctactccaagcccatcaccaccgtcgtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagccctcgcgtgccagctcctgggagggacgactgcagatccttttctaccgagttcttgagtgcattttgttctgtaaatttggaagcgtcatgggtgtctgtgggttatttaaaagaaattataatttgttaaaccattgcaatgttagatgttttttaagaagggaagagtcagtattttaagctcacttctagtgtgtcctgctcaaggtggaggctgatatttatgggccttggtggtttcttacccaccccttctagcgttccccagacgacagacacttggccctggctagctgggcaagggcagtccttagtgactccagggattcttgagaggcagaggccatgtcccacccgtggctgcaggtcgggttcctcgtaccaaggggaggctgagggcacagctggccccacttggggagggtagataacatctggactgcccggcttgggtctctgctcctcaccctagccctcttctccaatctgagcctaccctggcctcctgtctcctggctagggacacggctgtcccacaggtgccgtcttgggttatctcgctgctgttggctggtttcactctggaggttggcaccatggacacagctcagcgttgctctggcgcatatcctcctgagccacaccccaagtctggtgtgaggaagggcttctcttctcttcacagaggtgcctggcttcctgtgcagcacactgggtccaggacaggaggccccccccccaaaccaagcctcacgtgtgtgcctttatgaggcgttgggagaaagctaccctcctgtgtattctgttttctccatgagattgttgtgccatgtcacacttttgtatattcctagactaataaatggaaacaagaa

SEQ ID NO: 226 - DNA, 9938 bp, Mus musculus
gtggaatcgcagcgacacggacctgtccccccgcgtggccctggtgtcctcctcagtgcagagtttccagtgtgaccaagcacgcccgacccacactgcgcgcgcacagtgcacacctggcaccggccgcgagggggtgggggtgggaggacagagatgagggcgtcgggatgagccccgcgtggcccgcgcgaggccgggggcggggacggaagcaggcgggggctgcgcgttccttgtgctccagcgcgcgcccgtgcagggtcccggctgggggcggcgcgcgcgggcatcaccccaccggcggcggcgcgccgggtcccggggcgcagccccgacgctcattggcctgggcggcgcagccaagctgtcagcccatgtggcgtggccgcgcggggatggccgcggtttaaatagcgccggcgcggcctagagggagccagagagacggcagcggcgtcccgtccagttcgcctgccgcgctcctcgcttgtcgtctgcctccagagcccagacagagaagagccatggaggaggtggtgatagccggtatgtcggggaagttgcccgagtcagagaacctacaggagttctgggccaacctcattggtggtgtggacatggtcacagatgatgacaggagatggaaggctgggctctatggattacccaagcggtctggaaagctgaaggatctctccaagttcgacgcctccttttttggggtccaccccaagcaggcacacacaatggacccccagcttcggctgctgttggaagtcagctatgaagcaattgtggatggaggtatcaacccagcctcactccgaggaacgaacactggcgtctgggtgggtgtgagtggttcagaggcatccgaggcccttagcagagatcccgagacgcttctgggctacagcatggtgggctgccagcgtgcaatgatggccaaccggctctctttcttcttcgacttcaaaggaccaagcattgccctggacacagcctgctcctccagcttgctggcactacagaatgcctaccaggccatccgtagtggggaatgccccgcggcccttgtgggtgggatcaacctgctcctgaagccgaacacctctgtgcagttcatgaagctgggcatgctcagcccggacggcacctgcagatcctttgatgattcagggagtggatattgtcgctctgaggctgttgtagcagttctgctgactaagaagtccctggctcggcgggtctatgccacgattctgaatgccggcaccaatacagatggcagcaaggagcaaggtgtaacattcccctctggagaagtccaagaacaactcatctgctctctgtatcagccagctggtctggccccggagtcgcttgagtatattgaagcccatggcacgggcaccaaggtgggtgacccccaggaactgaatggcattactcggtccctgtgcgccttccgccaggcccctctgttaattggctccaccaaatccaacatgggacaccctgagcctgcctctgggcttgcagccctgaccaaggtgctgttatccctggagcatggggtctgggcccctaacctgcacttccacaaccccaaccctgagatcccagcacttcttgatgggcggctgcaggtggtcgataggcccctgcctgttcgtggtggcaacgtgggcatcaactcatttggcttcggaggctccaatgttcatgtcatcctccagcccaacacacggcaggcccctgcgcccactgcacacgctgcccttccccatttgctgcacgccagtggacgcaccttagaggcagtgcaggacctgctggaacagggccgccagcacagccaggacctggcctttgtgagcatgctcaatgacattgcggcaacccctacagcagccatgcccttcaggggttacactgtgctaggtgttgagggccgtgtccaagaagtgcagcaagtgtccaccaacaagcgcccactctggttcatctgctcagggatgggcacgcagtggcgcgggatggggctgagcctcatgcgcctggacagcttccgtgagtctatcctgcgctccgatgaggctgtgaagccgttgggagtgaaagtgtcagatctgctgttgagcacagatgagcgcacctttgatgacatcgtgcatgcctttgtgagcctcactgccatccagattgccctcatcgacctactgacttctgtgggactgaaacctgacggcatcattgggcactccttgggagaggttgcctgtggctatgcagatggctgtctctcccagagagaggctgtgcttgcagcttactggcgaggccagtgcatcaaagatgcccacctcccgcctggatccatggcagctgttggtttgtcctgggaggaatgtaaacagcgctgccccgctggcgtggtgcctgcctgccacaactctgaggacaccgtgaccatctctggacctcaggctgcagtgaatgaatttgtggagcagctaaagcaagaaggtgtgtttgccaaggaggtacgaacaggaggcctggctttccactcctacttcatggaaggaattgcccccacattgctgcaggctctcaagaaggtgatccgggaaccacggccgcgctcggctcgatggctcagcacctctatccctgaggcccagtggcagagcagcctggcccgcacatcttctgccgagtacaatgtcaacaacctggtgagccctgtgctcttccaggaagcactgtggcacatccctgagcatgccgtggtgctggagattgcgccccacgcactgttgcaggctgtcctgaagcgaggcgtgaagtccagctgcaccatcattcccttgatgaagagggatcataaagataacttggagttctttctcaccaaccttggcaaggtgcacctcacaggcatcaatgtcaaccctaacgccttgttcccacctgtggagttcccggctccccgagggactcctctcatctcccctcacatcaagtgggaccacagtcagacttgggatgtcccggttgctgaggacttcccaaacggctccagctcctcctctgctacagtctacagcatcgacgccagtcctgagtcgcccgaccactacctggtagaccactgcattgacggccgggtcatcttccctggcactggctacctgtgcctggtgtggaagacactggctcgcagcctgggcttgtccctagaagagacccctgtggtatttgagaatgtgtcgtttcatcaggccactatactacccaagacaggaaccgtggcgctggaggtgaggctgctagaggcctcccatgcctttgaggtgtctgacactggcaatctgattgtgagcggaaaagtgtacctgtgggaagacccgaactccaagttattcgaccacccagaagtcccaacaccccctgagtctgcatcggtctcccgcctgacccagggagaagtatacaaggagctgcggctgcgtggctatgattatggccctcagttccagggcatctgtgaggccacccttgaaggtgaacaaggcaagctgctctggaaagataactgggtgaccttcatggacacaatgctgcaggtatccattctgggttctagccagcagagtctacagctacctacccgtgtgaccgccatctatatcgaccctgccacccaccgtcagaaggtgtacaggctgaaggaggacactcaagtggctgatgtgacaacgagccgctgtctgggcataacggtctctggtggtatccacatctcaagactacagacgacagcaacctcacggcggcagcaagaacagctggtccccaccttggaaaagttcgttttcacaccgcacatggaggctgagtgcctgtctgagagcactgccctgcagaaggagctgcaactgtgcaagggtctggcacgggctctgcagaccaaggccacccagcaagggctgaaggcggcaatgcttgggcaagaggaccctccacagcacgggctgcctcgactcctggcagctgcttgccagttgcagctcaacgggaacctgcagctggagctgggagaagcgctggctcaagagaggctcctgctgccagaagaccctctgatcagtggcctcctcaactcccaggccctcaaggcctgcgtagacacagccctggagaacttgtctactctcaagatgaaggtggcagaggtgctggctggagaaggccacttgtattcccgaatcccggcactgctcaacacccagcccatgctacaactggaatacacagccaccgaccggcacccccaggccctgaaggatgttcagaccaaactgcagcagcatgatgtggcgcagggccagtggaacccttccgaccctgcgcccagcagcctgggtgcccttgaccttctggtgtgcaactgtgcattagccaccctgggggatccagccttggccctggacaacatggtagctgccctcaaggaaggtggtttcctgctagtgcacacagtgctcaaaggacatgcccttggggagaccctggcctgcctaccctctgaggtgcagcctgcgcccagcctcctaagccaggaggagtgggagagcctgttctcgaggaaggcactacacctggtgggccttaaaaggtccttctacggtactgcgctgttcctgtgccggcgagccatcccacaggagaaacctatcttcctgtctgtggaggataccagcttccagtgggtggactctctgaagagcactctggccacgtcctcctcccagcctgtgtggctaacggccatggactgccccacctcgggtgtggtgggtttggtgaattgtctccgaaaagagccgggtggacaccggattcggtgtatcctgctgtccaacctcagcaacacatctcacgcccccaagttggaccctggctctccagagctacagcaggtgctaaagcatgacctcgtgatgaacgtgtaccgggacggggcctggggtgccttccgtcacttccagttagagcaggacaagcccaaggagcagacagcgcatgcctttgtaaacgtcctcacccgaggggacctcgcctccatccgctgggtctcctcccccctgaagcacacgcagccctcgagctcaggagcacagctctgcactgtctactacgcctcactgaacttccgagacatcatgctggccacgggcaagctgtcccctgatgccattccaggtaaatgggccagccgagactgcatgctcggcatggagttctcaggccgggataggtgtggccggcgtgtgatggggctggttcctgcagaaggcctggccacctcagtcctgctatcatctgacttcctctgggatgtaccctccagctggaccctggaggaggcggcctctgtgcccgtcgtctataccactgcttactactcgttagtggttcgcgggcgcatccagcgtggggagaccgtgctcatccactcaggttcaggtggtgtgggccaagcggccatttccattgccctcagtctgggctgccgcgtcttcaccactgtgggctctgcagagaagcgagcatacctccaggccaggttccctcagcttgatgacaccagctttgccaactcgagggacacatcatttgagcagcacgtgttactgcacacaggtggcaaaggggtcgacctggtcctcaactcactggcagaagagaagctgcaggccagtgtgcggtgcttggctcagcatggtcgcttcttagagattggcaaatttgatctttctaacaaccaccctctgggcatggctatcttcttgaagaacgtcactttccatgggatcctgctggacgccctttttgaggaggccaatgacagctggcgggaggtggcggcactcctgaaggctggcattcgtgatggagtcgtgaagcccctcaagtgcacagtgtttcccaaggcccaggtggaagatgccttccgctacatggctcaggggaaacacattggcaaagtccttgtccaggtacgggaggaggagcctgaggctgtgctgccaggggctcagcccaccctgatttctgccatctccaagaccttctgcccagcccataagagttacatcatcactggtggcctaggtggctttggcctggagctggcccggtggctcgtgcttcgcggagcccagaggcttgtgctgacttcccgatctggaatccgcaccggctaccaagccaagcacattcgggagtggagacgccagggcatccaagtgctcgtgtcaacaagcaacgtgagctcactggagggggcccgtgctctcatcgccgaagccacaaagctggggcccgttgggggtgtcttcaacctggccatggttttgagggatgccatgctggagaaccagaccccagagctcttccaggatgtcaacaagcccaaatacaatggcaccctgaaccttgacagggcaacccgggaagcctgccctgagctggactactttgtggccttctcctctgtaagctgcgggcgtggtaatgctggccaaactaactacggcttcgccaactctaccatggagcgtatatgtgaacagcgcaggcacgatggcctcccaggccttgccgtgcagtggggtgccattggtgacgtgggcattgtcctggaagcgatgggcaccaatgacacagtcatcggaggtacgctgcctcagcgcatctcctcctgcatggaggtactggacctcttcctgaatcagccccacgcagtcctgagcagctttgtgctggcagagaagaaagctgtggcccatggggacggggacacccagagggatctggtgaaagctgtagcacacatcctaggcatccgagacctcgcaggtattaacctggacagcacgctggcagacctcggcctggactcgctcatgggtgtggaagttcgtcagatcctggaacgagaacacgatctggtgctgcccatgcgtgaggtgcggcagctcacgctgcggaaacttcaggaaatgtcctccaagactgactcggctactgacacgacagcccccaagtccaggagtgacacgtctctgaagcagaaccaactgaacctgagcacactgctggtgaaccctgagggtcctaccctaacccagctcaactcggtgcagagctctgagcggcctctgttccttgtgcaccccattgagggttccaccaccgtgttccacagtctggctgccaagctcagtgtgcccacctacggcctgcagtgcacccaagctgcccccctggatagcattccgaacctggctgcctactacatagattgcatcaagcaagtgcagcctgagggaccctaccgcatagctgggtactcatttggagcctgtgtagccttcgagatgtgctcccagctgcaggcccagcagggcccagccccgacccacaacaacctcttcctgtttgacggctcacacacctacgtgttggcctacacccagagctaccgggcaaagatgaccccaggctgtgaagccgaggccgaggctgaggccttatgcttcttcataaagcagtttcttgatgtggaacacagcaaggtgctggaggccctgctgccactgaagagcctggaagatcgggtggctgcctccgtggaccttatcactaagagtcaccacagcctggaccgccgagagctgagctttgctgccgtgtccttctaccacaagctccgggcagctgatcagtataagcccaaggccaagtaccatggcaacgtgacactgctgcgtgccaagacaggcggcacctatggcgaggacttgggtgctgactacaacctctcccaggtgtgtgacgggaaggtgtctgtgcacatcattgagggtgaccaccgcacactgctggagggcagtggcctggaatccatcatcaacatcatccatagctccctggctgagccacgagtgagtgtacgggagggctagacctgccgaccaccatgaagccacgctccacacctgccaccagagatgctccgatccccaccacaccctgagtgcaggaactggggagggtcctgctggtgggacccctccccccagtggcccagcaccacccgctcccctggtggctgctacaaacagaccatcacgcgtgtgtttcccagccgcgtagtggggttcccagagccactgacttggagacaccctggtctgtgaagagtcagtggaggcaggagccaaactgagccttttctaccgtgtggcatttgccacgctggtcgtttctccattaaattctcatatttattgcattgctgggaaagacccccaggggtgactcattccagaaccccctaaaatgggagaagccatgtggggaagatttctgggaaagtttctagactcaatacacaggctgctggctggagcccctttttgtcttgtcctgtccctgctcactgcagggcaggatatggagagggctggttcccagggaacaaggaccccagcagacactgtagcccgtggcccttggtccccagcatccccggctgccccatgatgcagggccatcctgactctgcggaccgcaccgggcactgactgtctgttttccaagacgaaaatgatgcttgggttttgacttttctgcagctgtcagtgtgaagaagtgtctggactgtgtcatttttacaccaacctggtaaaaatgctgctcttgatgctctcctgatcccacaattaaactgcacgtgagcgagcactgccttcggttcagtctctttccagtccaggcccggcttcaggctctgatacttatgggtattccccacaagtggcctccacagctcttccagtgagactccttggagggtgtgccattctgtcagtataaggggagtatgctaaaatgtgtttcagcatggagggctggctggaggccttgccactgtagtacaagcagaatttgtccacctttaagttgccctgagggcatcagcttagtcacagccccgccccagcggtagagaatagcatcatcctctacttgtagtcaactgagtgttggtgcaagccctctagagaaaaacgtaagcagtatgtgaccactgtgagaagcatgtccctggaaacaggtgacatgacgagagcagagggcctgagtcacacagaactgaccatgtgtgtaagcagaggagtggaggttgcttggaagaggaggatcaagagaaaagtaggctcagtttagtggacccacagtagcagccaatgtaattacattggcttggagctaaggcatggtgggtcctgcagggtggcttgttggactaggcaaagtcccctggcttgagggtccaggagagactgtcacaaggccgcagcattcgatcacatccagagaggagcatccagaggacaactgcattggtagggtacaaaggtgttcagaggatcccagtctgagtgattagcctaagactgaagcatctggttggctctagtcacacttagaaaaattcttacagcactcgtcatgagttgtccattcctggaaaggacctgcccaatctctatagtgtctctacctagttagagtttactgactcaagggagcagatttataaacttgcagaaaggcccgactcccttacgaggctgtgtggtccttagaattcatggatgagaggcaataaaaccttgaggttccttcctgttctttgtgattgcctaacaagacataaactgggtgtgatgagattgctcagtggatagagcgctgtgcagcctgagtttgatcactggaacccatgcagcagtagaaaagactaagttgtcctctgacctccacacatctgttgagtggaacaagactgaaat

SEQ ID NO: 227 - DNA, 2043 bp, Mus musculus
tgcacacagatcacctttcctatcaaccccactagcctctggcaaaatgaagtgggtaacctttctcctcctcctcttcgtctccggctctgctttttccaggggtgtgtttcgccgagaagcacacaagagtgagatcgcccatcggtataatgatttgggagaacaacatttcaaaggcctagtcctgattgccttttcccagtatctccagaaatgctcatacgatgagcatgccaaattagtgcaggaagtaacagactttgcaaagacgtgtgttgccgatgagtctgccgccaactgtgacaaatcccttcacactctttttggagataagttgtgtgccattccaaacctccgtgaaaactatggtgaactggctgactgctgtacaaaacaagagcccgaaagaaacgaatgtttcctgcaacacaaagatgacaaccccagcctgccaccatttgaaaggccagaggctgaggccatgtgcacctcctttaaggaaaacccaaccacctttatgggacactatttgcatgaagttgccagaagacatccttatttctatgccccagaacttctttactatgctgagcagtacaatgagattctgacccagtgttgtgcagaggctgacaaggaaagctgcctgaccccgaagcttgatggtgtgaaggagaaagcattggtctcatctgtccgtcagagaatgaagtgctccagtatgcagaagtttggagagagagcttttaaagcatgggcagtagctcgtctgagccagacattccccaatgctgactttgcagaaatcaccaaattggcaacagacctgaccaaagtcaacaaggagtgctgccatggtgacctgctggaatgcgcagatgacagggcggaacttgccaagtacatgtgtgaaaaccaggcgactatctccagcaaactgcagacttgctgcgataaaccactgttgaagaaagcccactgtcttagtgaggtggagcatgacaccatgcctgctgatctgcctgccattgctgctgattttgttgaggaccaggaagtgtgcaagaactatgctgaggccaaggatgtcttcctgggcacgttcttgtatgaatattcaagaagacaccctgattactctgtatccctgttgctgagacttgctaagaaatatgaagccactctggaaaagtgctgcgctgaagccaatcctcccgcatgctacggcacagtgcttgctgaatttcagcctcttgtagaagagcctaagaacttggtcaaaaccaactgtgatctttacgagaagcttggagaatatggattccaaaatgccattctagttcgctacacccagaaagcacctcaggtgtcaaccccaactctcgtggaggctgcaagaaacctaggaagagtgggcaccaagtgttgtacacttcctgaagatcagagactgccttgtgtggaagactatctgtctgcaatcctgaaccgtgtgtgtctgctgcatgagaagaccccagtgagtgagcatgttaccaagtgctgtagtggatccctggtggaaaggcggccatgcttctctgctctgacagttgatgaaacatatgtccccaaagagtttaaagctgagaccttcaccttccactctgatatctgcacacttccagagaaggagaagcagattaagaaacaaacggctcttgctgagctggtgaagcacaagcccaaggctacagcggagcaactgaagactgtcatggatgactttgcacagttcctggatacatgttgcaaggctgctgacaaggacacctgcttctcgactgagggtccaaaccttgtcactagatgcaaagacgccttagcctaaacacatcacaaccacaaccttctcaggctaccctgagaaaaaaagacatgaagactcaggactcatcttttctgttggtgtaaaatcaacaccctaaggaacacaaatttctttaaacatttgacttcttgtctctgtgctgcaattaataaaaaatggaaagaatctac

SEQ ID NO: 228 - DNA, 10018 bp, Homo sapiens
ggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtctttctggaagtggatatctactcagacagtaagaattataagagctgtaagagctcattttggaggaataatggatgaaccatctcccttggcccaacctctggagctgaaccagcactctcgattcataataggttctgtgtctgaagataactcagaggatgagatcagcaacctggtgaagttggacctactggaggagaaggagggctccttgtcacctgcttctgttggctcagatacactctctgatttggggatctctagcctacaggatggcttggccttgcacataaggtccagcatgtctggcttgcacctagtaaagcagggccgagacagaaagaaaatagattctcaacgagatttcactgtggcttctccagcagaatttgttactcgctttgggggaaataaagtgattgagaaggttcttattgctaacaatggcattgcagcagtgaaatgcatgcggtctatccgtaggtggtcttatgaaatgtttcgaaatgaacgtgcaattagattcgttgtcatggtcacacctgaagaccttaaagccaatgcagaatacattaagatggcagatcactatgtgccagtgcctggaggaccaaacaacaacaactatgcaaatgtggaattaattcttgatattgctaaaaggatcccagtacaagcagtgtgggctggctggggtcatgcttctgagaatcccaaactaccggaacttctcttgaaaaatggcattgccttcatgggtcctccaagccaggccatgtgggctttaggggataagattgcatcttccatagtggctcaaactgcaggtatcccaactcttccctggagcggcagtggtcttcgtgtggactggcaggaaaatgatttttcaaaacgtatcttaaatgttccccaggagctatatgaaaaaggttatgtgaaagatgtggatgatgggctacaggcagctgaggaagttggatatccagtaatgatcaaggcctcagagggaggaggagggaagggaattagaaaagtcaacaatgcagatgacttccctaatctcttcagacaggttcaagctgaagttcctggatctcccatatttgtgatgagactagccaaacaatctcgtcatctggaggtgcagatcttagcggaccaatatggcaatgctatctctttgtttggtcgtgattgctctgtacaacgcaggcatcagaagattattgaagaagcacctgctactattgctactccagcagtatttgaacacatggaacagtgtgcggtgaaacttgccaaaatggtgggttatgtgagtgctgggactgtggaatacctgtacagccaggatggcagcttctactttctggaattgaatcctcggctgcaggtagagcacccttgtacagagatggtggctgatgtcaatctccctgcagcacagctccagattgccatggggattcctctatatagaatcaaggatatccgtatgatgtatggggtatctccctggggtgattctcccattgattttgaagattctgcacacgttccttgtccaaggggccatgttattgctgctcggatcactagtgaaaatccagatgagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcaaacatggtggtggctttgaaggagctgtctattcggggtgactttcgaactacagttgaatacctgatcaaattgttagagactgaaagctttcagatgaacagaattgatactggctggctggacagactgatagcagaaaaagtacaggctgagcgacctgacaccatgttgggggttgtgtgtggtgccctccacgtggcagatgtgagcctgcggaatagcgtctctaacttccttcactccttagaaaggggtcaagtccttcctgctcatacacttctgaatacagtagatgttgaacttatctatgagggagtcaagtatgtacttaaggtgactcgacagtcccccaactcctatgtggtgatcatgaatggctcatgtgtagaagtagatgtacatcggctgagtgacggtggactgctcttgtcctatgatggcagcagttatactacgtatatgaaagaggaagtggatagatatcgcatcacaattggcaataaaacctgtgtgtttgagaaggaaaatgacccatcggtgatgcgctcaccttctgctgggaagttaatccagtacattgtagaagatggaggtcatgtgtttgccggccagtgctatgctgagattgaggtaatgaagatggtaatgaccttaacagctgtggagtctggctgtatccattacgtcaagcgacctggagcagctcttgaccctggctgtgtactagccaaaatgcaactggacaaccccagcaaggttcagcaggctgaacttcacacaggtagtctgccacggatccagagcacggcactcagaggcgagaaactccatcgagtgttccattatgtcctggataatctggtcaatgtaatgaatggatactgccttccagatcctttctttagcagcaaggtaaaagactgggtagagcgattgatgaaaaccctcagagatccctccctgcctctcctagaattgcaagatattatgaccagtgtgtctggccgcattccccccaatgtggagaagtctatcaagaaggaaatggctcagtatgctagcaacatcacatcagtcctctgtcagtttcccagccagcagattgcaaacatcctagatagccatgcagctacattgaaccggaaatctgaacgggaagtcttctttatgaatactcagagcattgttcagctggtacagaggtaccgaagtggcatccgaggccacatgaaggctgtggtgatggatctgctccggcagtacctgcgagtagagacacaattccagaatggtcactatgacaaatgtgtattcgccctccgagaagagaataaaagtgacatgaacactgtactgaactacatcttctctcacgctcaagtcaccaagaagaatcttctggtcacaatgcttattgatcagttgtgtggccgggaccctactctcactgatgagctgctgaatattctcacagagctaactcaactcagtaagaccaccaatgccaaagtagcacttcgagcacgccaggttcttattgcctcccatttgccatcatatgagcttcgccataaccaagtagagtctatcttcctatcagctattgacatgtatggacatcaattttgcattgagaacctgcagaaactcatcctatcagaaacatctatttttgatgtcctaccaaacttcttctatcacagcaaccaagtagtgaggatggcagctctggaggtgtatgttcgaagggcttatattgcctatgaacttaacagcgtacaacaccgccagcttaaggacaacacctgtgtggtggaattccagttcatgctgcccacatctcatccaaacagagggaacatccctacgctaaacagaatgtccttctcctccaacctcaaccactatggcatgacccatgtagctagtgtcagcgatgtactgttggacaactcattcactccaccttgtcagcggatgggcggaatggtctcttttcggacttttgaagattttgtcaggatctttgatgaagtgatgggctgcttctctgactccccaccccagagtcccacattccctgaggcaggtcacacgtctctttatgatgaggataaggttcccagggatgaaccaattcacattctcaatgtggctatcaagactgactgtgatattgaggatgacaggctggcagctatgttcagagaatttacccagcaaaataaagctaccctggttgaccatgggatccggcgccttactttcctggttgcacaaaaggatttcagaaagcaggtcaactatgaggtggatcggagatttcatagagaattccctaaattttttacattccgagcaagggataagtttgaggaggatcgtatctatcgtcatctggagcctgctctggctttccagttagagctgaaccggatgagaaattttgacctcactgccattccatgtgctaatcacaagatgcacctgtatctcggggcagccaaggtggaagtgggcacagaagtgacagactacaggttctttgttcgtgcaatcatcaggcattctgatctggtcaccaaggaagcttcttttgaatatctgcaaaatgaaggggagcggctactcctggaagccatggatgagttggaagttgcttttaacaatacaaatgtccgcactgactgtaaccacatcttcctcaactttgtgcccacggttatcatggacccatcaaagattgaggaatccgtgcggagcatggtaatgcggtatggaagtcgcctgtggaaattgcgcgtcctccaggcagaactgaaaatcaacattcgcctgacgccaactggaaaagcaattcccatccgcctcttcctgacaaacgagtctggctattacttggatatcagcctatacaaggaagtgactgactccaggacagcacagatcatgtttcaggcatatggagacaaacagggaccactgcatggaatgttaatcaatactccatatgtgaccaaagacctgctgcaatcaaagaggttccaggcacaatccttagggacaacatacatatatgatatcccagagatgtttcggcagtccctgatcaaactctgggagtctatgtccactcaagcatttcttccatctccccctctgccttctgacatgctgacttacactgaactggtactggatgatcaaggtcagctggtccacatgaacaggcttccaggaggaaatgagattggcatggtagcttggaaaatgacctttaaaagtcctgaatatccagaaggccgagatatcattgttattggcaatgacatcacataccgaattgggtcctttgggcctcaagaggatttgttatttctcagagcttccgaacttgctagggcagaaggtattccacgcatctatgtatcagccaacagtggagcaagaatcggactggcagaagaaattcgccatatgtttcatgtggcctgggtagatcctgaggatccttacaagggatacaggtatttatatctgactcctcaagattataagagagtcagtgctctcaactctgtccattgtgaacacgtggaagatgaaggagaatccaggtacaagataacagatattattgggaaagaagagggaattggacccgagaaccttcgaggttctggaatgattgctggagaatcctcattggcctataatgagatcattaccatcagcctggtgacgtgccgggccattgggattggggcttaccttgtccggctgggacagagaaccatccaggttgagaattctcacttaattctaacaggagctggagccctcaacaaagtcctcgggcgggaagtgtacacctccaataaccagctggggggcatccagattatgcacaacaatggggtgacccactgcactgtgtgtgatgactttgaaggggttttcactgtcctgcactggctgtcttacatgcccaagagcgtgcacagttcagttcctcttctgaactcaaaggatcctatagacagaatcatcgagtttgttcccacaaagaccccatacgatcctcgatggatgctagcaggccgtcctcacccaacccaaaaaggtcagtggttgagtggcttttttgactatggatctttctcagagattatgcagccctgggcacagactgtggtggttggtagagccaggctaggaggaatacctgtgggagttgttgctgtagaaacccgaacagtagaactaagtatcccagctgatccagcaaacctggattctgaagccaagataatccagcaggctggccaggtttggttcccagattctgcgtttaagacgtatcaggccatcaaggacttcaaccgggaagggctgcctctgatggtctttgccaactggagaggcttctctggtggaatgaaagatatgtacgaccaagtgctgaagtttggtgcttacattgtggatggcttgagggagtgctgccagcctgtgctggtttacattcctccccaggctgagctgcggggtggctcctgggtggtgattgactcctccatcaacccccggcacatggagatgtatgctgaccgagaaagcaggggatctgttctggagccagaagggacagtagaaatcaaattccgcagaaaggatctggtgaaaaccatgcgtcgggtggacccagtctacatccacttggctgagcgattggggaccccagagctaagcacagctgagcggaaggagttggagaacaagttgaaggagcgggaggaattcctaattcccatttaccatcaggtagccgtgcagtttgctgacttgcacgacacaccaggccggatgcaggagaagggtgttattagcgatatcctggattggaaaacatcccgtaccttcttctactggcggctgaggcgtcttctgctggaggacctggtcaagaagaaaatccacaatgccaaccctgagctgactgatggccagattcaagccatgttaaggcgctggtttgtggaagtggaaggaacagtgaaggcttatgtttgggacaataataaggatctggcggagtggctagagaaacagctgacagaggaggatggtgttcactcggtaatagaggaaaacatcaaatgcatcagcagagactacgtcctcaagcaaatccgcagcttggtccaggccaatccagaggttgccatggattccatcatccatatgacgcagcacatatcacccactcagcgagcagaagtcatacggatcctctccacaatggattccccttccacgtaggaagagcttcctgcctgtccctgccctgtctctggagaaaagggctagagctgccttttacaactgtaaccactgtaatgagaaggcacaggagacccagcactggagtcaaatggcattttacttcctctcgtttcaggttatgcatgacatcctgggatgtaagatcacagaatccccctccagcccaccagtcacacctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggcctcccagcatggggaagcgtgaggagttgcccagcagtgagcagcccccctcactcctggccccatgagccgcagccacaggcagcagaggagggctaaggagaggaggaagcctcaagtccattgtttattaccccgactcttagcccagcacacagtaggcactggagaggaatgattcccagtttaaccacactacggtaccttttatgaagaaaaattagagcataaaatctactacaagctccataggaactcaaagatgagggcaaaactgtgagccaagaagcagagaaagaaaatagaaccagttattcttgatttaggggacctcaaccttgggttcagtctctgaggacaaagggaaaggtagttgttggcctgcctctcgcctgcacgtcactgctggactagctgtcgcatgtggctgggagctgcaaggccagtgcttgaggggccccagcagttccacaggtggtgaagcctgagttggcagaggaggagccagaagagaactgccctttctgcactggtggaaactagttatttatgccatgtggagagccagtgagatagatagatagtctgtttgttttgaggacttggaaagttgttcctatgaagcctggagcttggatggttttgagaggttaatggtgcctccacactcactcttccctagttccaggattactgtcctagcagctaacggttctactctcttccccagagtgtagacaggcagcaggtctccccacagctctgaaaggaccctggtgacagctacaccctcagcaccaggagctggccttcctgatgagggaggcttccaggaaacacagaatccacatgaccttaagattatttacaactcagtcatggtgctgctgtcctccaggcttactggcccctcctgactggcatcaggggcttcctcaggtggtggagagagtttactttcaacaactagtttattcaagaaaagaacttactgattcctctgttcctaaagcaagagtggcaggtgatcagggctggtgtagcatccggttcctttagtgcagctaactgcatttgtcactgatgaccaaggaggaaatcactaagacatttgagaagcagtggtatgaacgttcttggacaagccacagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagaaaaaaaaaaaaaaaaaaaaaaaaaaaaaa

SEQ ID NO: 229 - DNA, 9054 bp, Mus musculus
ctctgagagcttattttgaaagaataatggatgaaccatctccgttggccaaaactctggagctaaaccagcactcccgattcataattgggtctgtgtctgaagacaactcagaagatgagatcagtaacctggtgaagctggacctagaagagaaggagggctccctgtcaccagcctccgtcagctcagatacactttctgatttggggatctctggcttacaggatggtttggcctttcacatgagatccagcatgtctggcttgcacctagtaaaacaaggtcgagacagaaagaaaatagactcacaacgagatttcactgtggcttctccagcagaatttgttactcgttttgggggaaataaagtaattgagaaggttcttatcgccaacaatggtattgcagcagtgaaatgcatgcgatctatccgtcggtggtcttatgaaatgtttcgaaatgaacgtgcaatccgatttgttgtcatggttacacctgaagaccttaaagccaatgcagaatacattaagatggcagaccactatgttccagtgcctggaggacccaacaacaacaattacgcaaatgtggagttgattcttgatattgctaaaaggatacctgtacaagcagtgtgggctggctggggtcatgcctctgagaacccgaaactcccagaactgctcttaaaaaatggcattgctttcatgggccctccaagccaggccatgtgggctttgggggataagattgcatcttctattgtggctcaaactgcaggtatcccaactcttccctggagtggcagtggtcttcgagtggattggcaagaaaatgatttttcgaaacgtatcttaaatgttccacaggatctgtatgagaaaggctatgtgaaggatgtggatgatggtctgaaggcagctgaggaagttggctatccagtgatgatcaaggcctcagagggaggaggagggaaagggatcagaaaagttaacaatgcagatgacttccctaacctcttcagacaggttcaagctgaagttcctggatcacctatatttgtaatgagactagcaaaacaatctcgacatctggaggtccagattctggcagatcagtatggcaatgctatttctttgtttggtcgtgactgctctgtgcagcgcaggcatcagaagatcattgaagaagctcctgctgcgattgctaccccagcagtatttgaacacatggaacagtgtgcagtgaaacttgccaaaatggttggttatgtgagtgctgggactgtggaatacttgtacagccaggatggaagcttctactttttggaactgaaccctcggctacaggttgaacatccttgtacagagatggtggctgatgtcaatcttcctgcagcacagctccagattgccatggggatccctctatttaggatcaaggatattcgtatgatgtatggggtatctccttggggagatgctcccattgattttgaaaattctgctcatgttccttgcccaaggggccacgtgattgctgctcggatcaccagtgaaaacccagatgaggggtttaagcccagctctggaacagttcaggaacttaattttcgtagcaataagaacgtttggggttatttcagtgttgctgctgctggaggacttcatgaatttgctgattctcagttcgggcactgcttttcctggggagaaaacagggaggaagcaatctcaaatatggtggtggcactgaaggagctgtctattcggggtgactttcgaactacagtggaatacctcatcaaactgctggagacagaaagctttcagcttaacagaatcgacactggctggctggacagactgatcgcagagaaagtgcaggcagagcgacctgacaccatgttgggagttgtgtgtggggctctccatgtagcagatgtgagcctgaggaacagcatctctaacttccttcactccttagagaggggtcaagtccttcctgctcacacacttctgaacacagtagatgttgaacttatctatgaaggaatcaaatatgtacttaaggtgactcggcagtctcccaactcctacgtagtgataatgaatggctcgtgtgtggaagtggatgtgcatcggctgagtgatggtggcctgctcttgtcttatgacggcagcagttacaccacatacatgaaggaagaggtggacagatatcgaatcacaattggcaataaaacctgtgtgtttgagaaggaaaatgacccatctgtaatgcgctcaccgtctgctgggaagttaatccagtatattgtggaagatggcggacatgtgtttgctggccagtgctatgctgagattgaggtaatgaagatggtgatgactttaacagctgtagaatctggctgcatccattatgtcaaacgacctggagcagcacttgaccctggctgtgtgatagccaaaatgcaactggacaaccccagtaaagttcaacaggctgagcttcacacgggcagtctaccacagatccagagcacagctctcagaggcgagaagctccatcgagttttccactatgtcctggataacctggtcaatgtgatgaatggatactgccttccagaccctttcttcagcagcagggtaaaagactgggtagaaagattgatgaagactctgagagacccctccttgcctctgctagagctgcaggatatcatgaccagtgtctctggccggatccccctcaatgtggagaagtctattaagaaggaaatggctcagtatgctagcaacatcacatcagtcctgtgtcagtttcccagccagcagattgccaacatcctagatagtcatgcagctacactgaaccggaaatctgagcgggaagtcttcttcatgaacacccagagcattgtccagctggtgcagaggtaccgaagtggcatccgtggccacatgaaggctgtggtgatggatctgctgcggcagtacctgcgagtagagacacagtttcagaacggccactacgacaaatgtgtattcgcccttcgggaagagaacaaaagcgacatgaacaccgtactgaactacatcttctcccacgctcaggtcaccaaaaagaatctcctggtgacaatgcttattgatcagttatgtggccgggaccctacacttactgatgagctgctaaatatcctcacagagctaacccaactcagcaagaccaccaacgctaaagtggcgctgcgcgctcgtcaggttcttattgcttcccatttgccatcatatgagcttcgccataaccaagtagagtctatcttcctatcagccattgacatgtatggacaccagttttgcattgagaacctgcagaaactcatcctctcggaaacatctattttcgatgtcctcccaaactttttttaccacagcaaccaggtggtgaggatggcagctctggaggtgtatgttcgaagggcttacattgcctatgaactcaacagcgtacaacaccgccagcttaaggacaacacctgtgtggtggaatttcagttcatgctgcccacatcccatccaaacagagggaacatccccacgctaaacagaatgtcctttgcctccaacctcaaccactatggcatgactcatgtagctagtgtcagcgatgttctgttggacaacgccttcacgccaccttgtcagcggatgggcggaatggtctctttccggacctttgaagattttgtcaggatctttgatgaaataatgggctgcttctgtgactccccaccccaaagccccacattcccagagtctggtcatacttcgctctatgatgaagacaaggtccccagggatgaaccaatacatattctgaatgtggctatcaagactgatggcgatattgaggatgacaggcttgcagctatgttcagagagttcacccagcagaataaagctactttggttgagcatggcatccggcgacttacgttcctagttgcacaaaaggatttcagaaaacaagtcaactgtgaggtggatcagagatttcatagagaattccccaaatttttcacattccgagcaagggataagtttgaggaggaccgcatttatcgacacctggagcctgctctggctttccagttagagttgaaccggatgagaaattttgaccttactgccatcccatgtgctaatcacaagatgcacctgtaccttggggctgctaaggtggaagtaggcacagaagtgactgactacaggttctttgttcgtgcgatcatcaggcactctgatctggtcacaaaggaagcttctttcgaatatctacaaaatgaaggggaacgactgctcctggaagctatggatgaattggaagttgcttttaataatacaaatgtccgcactgactgtaaccacatcttcctcaactttgtgcccacggtcatcatggacccatcaaagattgaagaatctgtgcggagcatggtaatgcgctatggaagtcggctatggaaattgcgggtcctccaggcagaactgaaaatcaacattcgcctgacaacaactggaaaagcaattcccatccgcctcttcctgacaaacgagtctggctactacttggacatcagcctgtataaggaagtgactgactccaggacagcacagatcatgtttcaggcatatggagacaagcagggaccactgcatggaatgttaattaatactccatatgtgaccaaagaccttcttcaatcaaagaggttccaggcacagtccttaggaacaacatatatatatgatatcccagagatgtttcggcagtcactcatcaaactctgggagtccatgtccacccaagcatttcttccttcgcctcctttgccttccgacatcctgacgtatactgaactggtgttggatgatcaaggccagctggtccatatgaacagacttccaggaggaaatgagattggcatggtagcctggaaaatgagccttaaaagccctgaatatccagatggccgagatatcattgtcatcggcaatgacattacatatcggatcggttcctttgggcctcaggaggatttgctgtttctcagagcttctgaacttgccagagcagaaggcatcccacgcatctacgtggcagcgaacagtggagctagaattggacttgcagaagaaatacgccatatgttccatgtggcctgggtagatcctgaagatccctacaagggatacaagtatttatatctgacaccccaggattataagagagtcagtgccctcaattctgtccactgtgaacatgtggaggatgaaggggaatccaggtacaagataacagatattatcgggaaagaagaaggacttggagcagagaaccttcggggttctggaatgattgctggggaatcctcattggcttacgatgaggtcatcaccatcagcctggttacatgccgggccattggtattggggcttaccttgtccggctgggacaaagaaccatccaggttgagaattctcacttaattctgacaggagcaggtgccctcaacaaagtccttggtcgggaagtatacacctccaacaaccagcttgggggcatccagattatgcacaacaatggggttacccactccactgtttgtgatgactttgagggagtcttcacagtcttacactggctgtcatacatgccgaagagcgtacacagttcagttcctctcctgaattccaaggatcctatagatagaatcatcgagtttgttcccacaaaggccccatatgatcctcggtggatgctagcaggccgtcctcacccaacccagaaaggccaatggttgagtgggttttttgactatggatctttctcagaaatcatgcagccctgggcacagaccgtggtagttggcagagccaggttagggggaatacccgtgggagtagttgctgtagaaacccgaacagtggaactcagtatcccagctgatcctgcgaacctggattctgaagccaagataatccagcaggccggccaggtttggttcccagactctgcatttaagacctatcaagctatcaaggactttaaccgtgaagggctacctctaatggtctttgccaactggagaggtttctctggtgggatgaaagatatgtatgaccaagtgctcaagtttggcgcttacattgtggatggcttgcgggaatgttcccagcctgtaatggtttacatcccgccccaggctgagcttcggggtggttcttgggttgtgatcgaccccaccatcaaccctcggcacatggagatgtacgctgaccgagaaagcaggggatctgttctggagccagaagggacagtagaaatcaaattccgtaaaaaggatctggtgaaaaccatgcgtcgggtagatccagtttacatccgcttggctgagcgattgggcaccccagagctaagccccactgagcggaaggagctggagagcaagttgaaggagcgggaggagttcctaattcccatttaccatcaggtagctgtgcagtttgctgacttgcacgacacaccaggccggatgcaggagaagggtgtcattaacgatatcttggattggaaaacatcccgcaccttcttctactggaggctgaggcgcctcctgctggaggacctggtcaagaagaaaatccacaatgccaaccctgagctgactgacggccagatccaggccatgttgagacgctggtttgtagaagttgaaggcacagtgaaggcttacgtctgggacaataataaggacctggtggagtggctggagaagcaactgacagaggaagatggcgtccgctctgtgatagaggagaacatcaaatacatcagcagggactatgtcctgaagcagatccgcagcttggtccaggccaacccagaagtcgccatggactccatcgtccacatgacccagcacatctcacccacccagcgagcagaagttgtaaggatcctctccactatggattccccttccacgtaggaggagcttcccgcccacccctgccctgtctctggagaagagagtcgggctgcctctcccatctgagaccactgtaatgagaaggcaccggaggcctgagactggatcagtggcatttgcttcccttgagtgtttcaggctctgcatgacatcctgggctataggatcacacagcccagtcacacatacccgattcagtatttattagcccagctatgatgacagtcctcttcccatgcacaggactgagaaggcaatgaaaggtacttgcctgtaccatgaggtcttactagactaaagcaggactgccctccgtcctgcctgccccagcatagggtcgtgtgaacagtgtccaagtgtctgcagcccctgccccatgagccacagccaacaggggagggctggggctgccaggagacgcaagtccatcgatcactaccccacattgcaaccaagcacatgccaggcactggagagagacagtcccatctaaccacagcaagataactgagaaatgtcagagcagaaaatctgtcgcaagcccgtgagaacacagagataaaggcaaagccatgatctaacaggcaggctcaaaaccagatcatgtcattgttcctggtcaaacacactcaaccacctcagtggcgtctcagtatccctggggagacggtcaccctgccaccaccttatcactatgtaatcacatagtgactatacctaggagctaaaggcctgtgcataagggccctagcctctgcgggtggatggagacaggcaggcagtgcaggagcctgaggtggctaagaggaggctcttttctgttggtgataggggaagagtacttcaaaacaggagaagtctcttctggggacaggttgtcactatggggccatgcctattcctggcagaaggtatggcgggtcacccacctgatgacacctgtgctttcagcaccagaaactggccttcttgatgttaggaggcttccagggaacaagaattcacctgcccttaagataccttacagttcagtctcggtgctggtgtttccagacttctgggccctatgtggccagcaacacggcttcctcaggggtggcctgaaaagtttaactacccatttgtccaagaaagcagctgatggttcagcatttgtgttcataaagcaagaatgaagatgatcataactcgtataacatccagtttcaactttatgactaatacatctgtcgctgaagatcgagaaggaaaaagatacctgccacagaaaccattcaagtgagtacttcagtctgagccttaacctggattccacgaaaagagctgacctccccttcaggagcacctcaagcagatattccagaggaccttctcaatggtgccacattgcaagtggacatccaagggactatagatgcaagttgccccacccccacaagccctggtggaaggaacaggagggccagagctggatcaggtggggagcatccttagtccagaaggaagctccctggcccctggttccctgcttacctggtaggtaaggatgggatttatctctggcctccacttttgctacagcacgtccaatcccacacccccggtggtatgaaagctgctttcctggagaggtggagtgggctgggcttgtataagtcccttttccctgctgccccatccccgggaccgggccgtctcaatacggagaagtcagagccacggcacatgggcagtgtgatggtaccacagcccattacacatgcagggttactgaggaggagggtgaatgatgtattgacccagactggcttgaactgagattgccatattatctgtccacttgttcacaaagcagccttcacacgtgtcagtgagagttcgatggacacacacgccagcgagcaggggcttcagtccaatgcactcttctcacgttttgttgaaataaacctccacatttgtagaagaaaaaaaaaaaaaaaaaaaaaaa

SEQ ID NO: 230 - DNA, 9260 bp, Homo sapiens
attttctgaatggtcttgcttctttgtctatcttgtctgattttctcctgtctgaccttttcctggttaaaaatctgggggaaaatgacggactccaagccgatcaccaagagtaaatcagaagcaaacctcatcccgagccaggagccctttccagcctctgataactcaggggagacaccgcagagaaatggggagggccacactctgcccaagacacccagccaggccgagccagcctcccacaaaggccccaaagatgccggtcggcggagaaactccctaccaccctcccaccagaagcccccaagaaaccccctttcttccagtgacgcagcaccctccccagagcttcaagccaacgggactgggacacaaggtctggaggccacagataccaatggcctgtcctcctcagccaggccccagggccagcaagctggctccccctccaaagaagacaagaagcaggcaaacatcaagaggcagctgatgaccaacttcatcctgggctcttttgatgactactcctccgacgaggactctgttgctggctcatctcgtgagtctacccggaagggcagccgggccagcttgggggccctgtccctggaggcttatctgaccacaggtgaagctgagacccgcgtccccactatgaggccgagcatgtcgggactccacctggtgaagaggggacgggaacacaagaagctggacctgcacagagactttaccgtggcttctcccgctgagtttgtcacacgctttgggggggatcgggtcatcgagaaggtgcttattgccaacaacgggattgccgccgtgaagtgcatgcgctccatccgcaggtgggcctatgagatgttccgcaacgagcgggccatccggtttgttgtgatggtgacccccgaggaccttaaggccaacgcagagtacatcaagatggcggatcattacgtccccgtcccaggagggcccaataacaacaactatgccaacgtggagctgattgtggacattgccaagagaatccccgtgcaggcggtgtgggctggctggggccatgcttcagaaaaccctaaacttccggagctgctgtgcaagaatggagttgctttcttaggccctcccagtgaggccatgtgggccttaggagataagatcgcctccaccgttgtcgcccagacgctacaggtcccaaccctgccctggagtggaagcggcctgacagtggagtggacagaagatgatctgcagcagggaaaaagaatcagtgtcccagaagatgtttatgacaagggttgcgtgaaagacgtagatgagggcttggaggcagcagaaagaattggttttccattgatgatcaaagcttctgaaggtggcggagggaagggaatccggaaggctgagagtgcggaggacttcccgatccttttcagacaagtacagagtgagatcccaggctcgcccatctttctcatgaagctggcccagcacgcccgtcacctggaagttcagatcctcgctgaccagtatgggaatgctgtgtctctgtttggtcgcgactgctccatccagcggcggcatcagaagatcgttgaggaagcaccggccaccatcgccccgctggccatattcgagttcatggagcagtgtgccatccgcctggccaagaccgtgggctatgtgagtgcagggacagtggaatacctctatagtcaggatggcagcttccacttcttggagctgaatcctcgcttgcaggtggaacatccctgcacagaaatgattgctgatgttaatctgccggccgcccagctacagatcgccatgggcgtgccactgcaccggctgaaggatatccggcttctgtatggagagtcaccatggggagtgactcccatttcttttgaaaccccctcaaaccctcccctcgcccgaggccacgtcattgccgccagaatcaccagcgaaaacccagacgagggttttaagccgagctccgggactgtccaggaactgaatttccggagcagcaagaacgtgtggggttacttcagcgtggccgctactggaggcctgcacgagtttgcggattcccaatttgggcactgcttctcctggggagagaaccgggaagaggccatttcgaacatggtggtggctttgaaggaactgtccatccgaggcgactttaggactaccgtggaatacctcattaacctcctggagaccgagagcttccagaacaacgacatcgacaccgggtggttggactacctcattgctgagaaagtgcaggcggagaaaccggatatcatgcttggggtggtatgcggggccttgaacgtggccgatgcgatgttcagaacgtgcatgacagatttcttacactccctggaaaggggccaggtcctcccagcggattcactactgaacctcgtagatgtggaattaatttacggaggtgttaagtacattctcaaggtggcccggcagtctctgaccatgttcgttctcatcatgaatggctgccacatcgagattgatgcccaccggctgaatgatggggggctcctgctctcctacaatgggaacagctacaccacctacatgaaggaagaggttgacagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgatgaagatgatcatgaccctgaacgttcaggaaagaggccgggtgaagtacatcaagcgtccaggtgccgtgctggaagcaggctgcgtggtggccaggctggagctcgatgacccttctaaagtccacccggctgaaccgttcacaggagaactccctgcccagcagacactgcccatcctcggagagaaactgcaccaggtcttccacagcgtcctggaaaacctcaccaacgtcatgagtggcttttgtctgccagagcccgtttttagcataaagctgaaggagtgggtgcagaagctcatgatgaccctccggcacccgtcactgccgctgctggagctgcaggagatcatgaccagcgtggcaggccgcatccccgcccctgtggagaagtctgtccgcagggtgatggcccagtatgccagcaacatcacctcggtgctgtgccagttccccagccagcagatagccaccatcctggactgccatgcagccaccctgcagcggaaggctgatcgagaggtcttcttcatcaacacccagagcatcgtgcagttggtccagagataccgcagcgggatccgcggctatatgaaaacagtggtgttggatctcctgagaagatacttgcgtgttgagcaccattttcagcaagcccactacgacaagtgtgtgataaacctcagggagcagttcaagccagacatgtcccaggtgctggactgcatcttctcccacgcacaggtggccaagaagaaccagctggtgatcatgttgatcgatgagctgtgtggcccagacccttccctgtcggacgagctgatctccatcctcaacgagctcactcagctgagcaaaagcgagcactgcaaagtggccctcagagcccggcagatcctgattgcctcccacctcccctcctacgagctgcggcataaccaggtggagtccattttcctgtctgccattgacatgtacggccaccagttctgccccgagaacctcaagaaattaatactttcggaaacaaccatcttcgacgtcctgcctactttcttctatcacgcaaacaaagtcgtgtgcatggcgtccttggaggtttacgtgcggaggggctacatcgcctatgagttaaacagcctgcagcaccggcagctcccggacggcacctgcgtggtagaattccagttcatgctgccgtcctcccacccaaaccggatgaccgtgcccatcagcatcaccaaccctgacctgctgaggcacagcacagagctcttcatggacagcggcttctccccactgtgccagcgcatgggagccatggtagccttcaggagattcgaggacttcaccagaaattttgatgaagtcatctcttgcttcgccaacgtgcccaaagacacccccctcttcagcgaggcccgcacctccctatactccgaggatgactgcaagagcctcagagaagagcccatccacattctgaatgtgtccatccagtgtgcagaccacctggaggatgaggcactggtgccgattttacggacattcgtacagtccaagaaaaatatccttgtggattatggactccgacgaatcacattcttgattgcccaagagaaagaatttcccaagtttttcacattcagagcaagagatgagtttgcagaagatcgcatttaccgtcacttggaacctgccctggccttccagctggaacttaaccggatgcgtaacttcgatctgaccgccgtgccctgtgccaaccacaagatgcacctttacctgggtgctgccaaggtgaaggaaggtgtggaagtgacggaccataggttcttcatccgcgccatcatcaggcactctgacctgatcacaaaggaagcctccttcgaatacctgcagaacgagggtgagcggctgctcctggaggccatggacgagctggaggtggcgttcaataacaccagcgtgcgcaccgactgcaaccacatcttcctcaacttcgtgcccactgtcatcatggaccccttcaagatcgaggagtccgtgcgctacatggttatgcgctacggcagccggctgtggaaactccgtgtgctacaggctgaggtcaagatcaacatccgccagaccaccaccggcagtgccgttcccatccgcctgttcatcaccaatgagtcgggctactacctggacatcagcctctacaaagaagtgactgactccagatctggaaatatcatgtttcactccttcggcaacaagcaagggccccagcacgggatgctgatcaatactccctacgtcaccaaggatctgctccaggccaagcgattccaggcccagaccctgggaaccacctacatctatgacttcccggaaatgttcaggcaggctctctttaaactgtggggctccccagacaagtatcccaaagacatcctgacatacactgaattagtgttggactctcagggccagctggtggagatgaaccgacttcctggtggaaatgaggtgggcatggtggccttcaaaatgaggtttaagacccaggagtacccggaaggacgggatgtgatcgtcatcggcaatgacatcacctttcgcattggatcctttggccctggagaggaccttctgtacctgcgggcatccgagatggcccgggcagagggcattcccaaaatttacgtggcagccaacagtggcgcccgtattggcatggcagaggagatcaaacacatgttccacgtggcttgggtggacccagaagacccccacaaaggatttaaatacctgtacctgactccccaagactacaccagaatcagctccctgaactccgtccactgtaaacacatcgaggaaggaggagagtccagatacatgatcacggatatcatcgggaaggatgatggcttgggcgtggagaatctgaggggctcaggcatgattgctggggagtcctctctggcttacgaagagatcgtcaccattagcttggtgacctgccgagccattgggattggggcctacttggtgaggctgggccagcgagtgatccaggtggagaattcccacatcatcctcacaggagcaagtgctctcaacaaggtcctgggaagagaggtctacacatccaacaaccagctgggtggcgttcagatcatgcattacaatggtgtctcccacatcaccgtgccagatgactttgagggggtttataccatcctggagtggctgtcctatatgccaaaggataatcacagccctgtccctatcatcacacccactgaccccattgacagagaaattgaattcctcccatccagagctccctacgacccccggtggatgcttgcaggaaggcctcacccaactctgaagggaacgtggcagagcggattctttgaccacggcagtttcaaggaaatcatggcaccctgggcgcagaccgtggtgacaggacgagcaaggcttggggggattcccgtgggagtgattgctgtggagacacggactgtggaggtggcagtccctgcagaccctgccaacctggattctgaggccaagataattcagcaggcaggacaggtgtggttcccagactcagcctacaaaaccgcccaggccgtcaaggacttcaaccgggagaagttgcccctgatgatctttgccaactggagggggttctccggtggcatgaaagacatgtatgaccaggtgctgaagtttggagcctacatcgtggacggccttagacaatacaaacagcccatcctgatctatatcccgccctatgcggagctccggggaggctcctgggtggtcatagatgccaccatcaacccgctgtgcatagaaatgtatgcagacaaagagagcaggggtggtgttctggaaccagaggggacagtggagattaagttccgaaagaaagatctgataaagtccatgagaaggatcgatccagcttacaagaagctcatggaacagctaggggaacctgatctctccgacaaggaccgaaaggacctggagggccggctaaaggctcgcgaggacctgctgctccccatctaccaccaggtggcggtgcagttcgccgacttccatgacacacccggccggatgctggagaagggcgtcatatctgacatcctggagtggaagaccgcacgcaccttcctgtattggcgtctgcgccgcctcctcctggaggaccaggtcaagcaggagatcctgcaggccagcggggagctgagtcacgtgcatatccagtccatgctgcgtcgctggttcgtggagacggagggggctgtcaaggcctacttgtgggacaacaaccaggtggttgtgcagtggctggaacagcactggcaggcaggggatggcccgcgctccaccatccgtgagaacatcacgtacctgaagcacgactctgtcctcaagaccatccgaggcctggttgaagaaaaccccgaggtggccgtggactgtgtgatatacctgagccagcacatcagcccagctgagcgggcgcaggtcgttcacctgctgtctaccatggacagcccggcctccacctgaccgtggcccgcccagccactcccgggaccacggcaaaaggaaccacccagacccaccacccgtacaccctcagcagaccctgaagacttgcttttaaacaaagaaaatcctgggcacttctgcagggctgctggttccgagctgacacccgtcttaacaaaaggcccaggagtgcctcttccaaacaaaaacagcctcctctccatagctgggaagtttattttgttttgtctctgaagacagcagttttattgcatcactaaatctaatcaagctaaaacatccctgtttccttttgcaaaacagtgcctggcatgtgggatccaggcgttctttaggatccttggataccacatcgtgaaatcttttatttttttactctgagaccagcaccagatgtaagtaagcatctcatatatttcagccaaataaatgggccaagggaaaaaaatatatatatatagacaggactagagaaaacctatttttgtaatgatgtttctttggatactgtctagtcacccagaaaaatgtatggatgaatttttttttttttttttgagacaaagtctcactgtgtcatgcaggctggagtgcagtggcatgatctcactgcaacctccatctcctgtctcagcctcctagataactgggattacaggtgcccaccaccatgcccggctaatttttgtatttttggtagagacagagtttcaccaggttggtcaggctggtctcaaactcttgacttcaggtaatccacccaccttggcctcccaaagtgctgggattacaggcatgagccaccatcttcagccagatgatttttttattgagagagtgaaatgctattttgttccccaaatggcgctagtgaatcactaggagggtcccactgataggccatgtttagcactggttgccagggattctctttttgagagagggaaagcaaaatgaatggaagtacccagctggaggtttcagggcttctggaggatgctctcgcatagctcgaggtcctctgcccacctcttctctccaaggaaaatgaggactgccccttccccctgcaggattggcccccagcctgcgcatgcaccctcctcttgcccaagtggggagcacagaggcggagaggaatcccttaccacacccacggcccagcttgctcacgagtgtcacctctgtgacggtcaccactgctcccttggagggccacttgagttactgttgcttcctcgcctgctggcttgatgagcaccgatggtgggatctgaccccgaggggcagagctgtcggtgactgaggactggactgtggtgaccatgccgatttgctcagggagaacgttgcaatgcacccagcagctcctggctctgcaggcggcacagcctggggccctgtgatcctctggtttcttccattggggcggagtcggggatggagggagctggccacaacccactgctctgatgggtggtttgtccaaggatgctgaatgtaatgcctggtcaatgtggaagcccatgaggttgcccagggaagcctccaaaagctgggatgcttgagggtatccaagttgaaaaagacaaaatctgaccatcagccagtgacagtcctggcaaatgaaggtggggcggggcagtgaggggtgggagaaggtgaatgattcattattccaccccgaggtttgctggggtgaggggaagaatcgatgctgctttgggaactgaaggtttttctgttgggaaggccctcttggttttggagagaaagacaagttatgagtagctgctaccctggaacggtgggcagagagcctactaggaaatgtgcagaataaactattttttgaaggaaaaaaaaaaaaa

SEQ ID NO: 231 - DNA, 8497 bp, Mus musculus
atggtcttgcttctctttctgacttgcctggttttctcctgcctgaccttttcctggctaaaaatctgggggaagatgacagactcgaagccgctcaccaacagtaaggtggaagccaatctcctttcaagcgaggagtccctttcagcctcagagctgtcaggggaacagctgcaggaacatggcgaccacagctgtctgtcctacagaggtcccagagacgccagtcagcagaggaactccctgccaagctcatgccagaggcctccgaggaacccactgtcttccaatgacacctggccctccccagaactccaaaccaactggacagccgccccgggcccagaggttccagatgctaatgggttgtccttcccagccaggcccccgagccagaggacagtatccccctccagagaggacaggaagcaggcacacatcaagagacagctgatgaccagctttatcctgggctccctggatgacaactcctctgatgaggaccctagtgccggctccttccagaactcctcccggaagagcagcagggctagcctgggcactctgtcccaggaggctgcattgaacacaagtgatcctgaatctcacgcgcctactatgaggcccagcatgtctggactccatctggtgaagagaggccgagaacacaagaaactggacctgcacagagatttcaccgtcgcgtccccagccgagtttgtcactcggtttggaggcaacagggtcatagagaaggtgctcatcgccaacaatggcatcgctgcggtcaagtgtatgcgctccatccgccgctgggcctacgagatgttccgtaatgaacgtgccatccggttcgtggtcatggtgacgcccgaggatctgaaggccaacgcagagtacatcaagatggccgatcagtacgtccctgtcccaggaggacccaataacaacaactatgccaatgttgagctgatcatagacattgccaagagaatccctgtacaggccgtgtgggctggctggggccacgcttcggaaaaccccaaacttccagagctgctgtgtaaacacgagattgctttcctaggtccccccagtgaggccatgtgggccctgggagacaagatcgcctccaccatcgtagcgcagacactgcaaatcccaaccttaccctggagtggaagcggtctcacagtggagtggacggaggacagccggcaccagggcaaatgcatcagtgtccccgaagacgtttacgagcagggctgtgtgaaggatgtggacgaaggcttgcaggcagcagaaaaaataggatttcctttgatgatcaaagcctccgaaggcggaggcgggaaaggtatccgcaaggctgagagtgcagaggacttcccgatgcttttccgacaagtgcagagtgagattccgggctcgccgatctttctaatgaagctggcccagaacgcacggcacctggaggtccaggtcttggcagatcagtatggaaacgcggtgtcactgttcggacgggactgttccattcagaggcggcaccagaagatcattgaggaggctccggccaccatcgccgcgcctgccgtgtttgagttcatggaacagtgtgctgtcctcctggccaagatggtgggttatgtgagcgcggggactgtggagtacttatacagccaggatggcagcttccacttcctggagctgaacccacgcctgcaggtggagcatccgtgcactgaaatgatcgcagatgtcaacctgcctgctgcgcagttgcagatcgccatgggcgtgcccctgcaccgactgaaggacatacggcttctgtacggagagtccccctggggagtgacccccattccttttgaaacccccttgagccctcccattgcccgaggccacgtcattgcagccaggatcaccagcgaaaacccagatgagggctttaagccaagctcggggacagtgcaggagctgaacttccgcagcaacaagaacgtgtggggttacttcagcgtggccgctgctgggggcttgcacgagttcgccgattcccagtttgggcactgcttctcctggggcgagaaccgtgaagaggccatttcgaacatggtagtggctttgaaggaactgtccatccggggtgacttccggaccactgtggagtatctcgttaaccttctggagaccgagagcttccagaacaacgatatcgacacggggtggctggaccacctcatcgctcagcgggtgcaggcagagaagccggacatcatgcttggggtggtgtgtggggccttgaatgtggcagacgcgatgttcagaacctgcatgacggaattcttgcactccctggaaaggggtcaggtcctccctgctgattctctgctgaacattgtggacgttgaattgatttacggcggcatcaagtatgctctcaaggtagcccgacagtccctgactatgtttgtcctcatcatgaacggctgccacatcgagatcgatgcccaccggctgaacgatggggggctgctcctgtcctacaatggcagcagttacactacgtacatgaaggaagaggttgacagttaccggatcactatcggcaataagacttgcgtgtttgaaaaggaaaacgaccccactgtcctgagatccccctcggctgggaagctgatgcagtatacggtggaggacggagaccacgtggaagctgggagcagctacgcggagatggaggtgatgaagatgatcatgaccctgaacgtgcaggagagcggccgggtgaagtacatcaagcggccaggggttatactggaggctggctgcgtggtggcgaggctagaactcgatgacccttcaaaagtgcacgcggcccagccgtttactggggagctccctgcccagcagactctgcccatcctcggggagaagctacaccaagtgttccacggcgtcttggaaaatctgaccaatgtcatgagtggctactgcctgcccgagcccttcttcagcatgaagctgaaggactgggtccagaagctcatgatgacgctccggcatccctccctacctctgctggagctacaggagatcatgaccagtgtggccggccgcatccccgccccggtggagaaggcagtccgcagggtgatggcccagtacgccagtaacatcacctccgtgctatgccagttccccagccagcagatagccaccatcctggactgccatgccgccaccctgcagcgtaaggcggaccgagaggtcttcttcatgaacacacagagcatcgtgcagctggtccagagataccgcagcgggacccgtggctacatgaaggctgtggtgctggacctcctgaggaaatatctaaacgtggagcaccattttcagcaagcccactatgacaagtgtgtgatcaacctgagggagcagttcaagccggacatgacccaggtgctggactgcatcttctcacactcccaggtggccaagaagaaccagctggtgaccatgctgatagatgagctgtgcggcccagaccccaccctgtcagacgagctgacctccatcctctgtgagctcacgcagctgagcagaagcgagcactgcaaggttgccctcagagccagacaggtcctgatcgcctcccacctcccctcctacgagctgcggcacaaccaggtggagtccatcttcctgtccgccatcgacatgtacggccaccagttctgcccagaaaatctcaagaaactaatactttcagaaacgaccatattcgacgtcctgcccactttcttctatcacgagaacaaggttgtctgtatggcgtccctggaggtttacgtgcggagaggctacatcgcctacgagctaaacagcctgcagcaccgggagctcccagatggcacctgtgtggtggagttccagttcatgctgccctcttcccaccccaaccggatggccgtgcccatcagtgtctccaaccccgacctgctgaggcacagcacagaactcttcatggacagtggcttctccccactgtgccagcggatgggggccatggtggccttcaggagatttgaagaattcaccaggaactttgatgaagtcatctcctgctttgccaacgtgcagacagacactcttctcttcagtaaggcgtgcacttccctgtactcagaggaagacagcaagagcctccgagaggaacccatccacatcctgaatgtggccatccagtgtgccgaccacatggaggacgaggcgctggtgccagtcttccgtgcctttgtacagtccaagaagcacatccttgtggattacggactccgaagaatcacattccttgttgcccaagagagagaattccccaagttcttcacgttcagagcgagggatgagtttgcagaagaccggatttatcgccacttggagcctgccctggccttccagctggagctgagccggatgcgcaactttgacctgaccgctgtgccctgtgccaaccacaagatgcatctttacctgggagccgctaaggtgaaggaagggttggaggtgaccgaccacaggttctttatccgagccattatccggcactcagacctgatcaccaaggaagcctccttcgagtacctgcagaacgaaggtgagcggctgctgctggaagccatggacgagctggaggtggcgttcaacaacaccagtgtgcgcactgactgcaaccacatcttcctcaactttgtgcccacagtcatcatggacccgctcaagatcgaggagtcggtgcgtgacatggtcatgcgctatggcagccgtctgtggaagctccgagtgctgcaggccgaggttaagatcaacatccgtcagacaacctcagatagtgccatccccatccgcctcttcatcaccaacgagtctggctactacctggacatcagcctctatagagaagtgacggactccagatccggaaatatcatgtttcattcctttggcaacaagcaaggtagcctgcatgggatgctgatcaatacaccctatgtcaccaaggacctgctccaggctaagcgattccaggcacagtccctcgggaccacctatgtgtacgacttcccagagatgttcaggcaggctctctttaaactgtggggctccccagagaagtaccccaaagatatcctgacatacacagagctggtgttggactctcaaggtcagctggtggagatgaaccggcttcctggttgtaacgaggtgggcatggtggccttcaaaatgaggttcaagaccccggagtatccagaaggccgggacgccgttgtcatcggcaatgacatcaccttccaaatcggctctttcggcataggggaggacttcctgtacctgcgagcgtctgagatggcccggacagagggcatcccccaaatctacctggcagctaacagcggggcccgtatgggcctggctgaggagatcaaacagatattccaagtggcttgggtggacccagaggatccccacaaaggatttagatacctgtacctgacgccccaagactacacccagatcagttcccagaactcagtgcactgcaagcacatcgaagatgaaggcgaatccagatacgtcatcgtggatgtcatcgggaaggatgccaacctgggtgtggagaacctgaggggctcgggcatgattgcaggagaagcttccctggcttatgagaaaacggtcaccatcagcatggtgacctgccgcgcccttggaatcggggcttacctggtgaggcttggccagcgggtgatccaggtggaaaactcccacatcatcctcaccggagccggtgctctcaacaaggtcctgggaagagaggtctacacgtccaacaaccagctaggtggcgtgcagatcatgcataccaacggggtctcccacgtcaccgtgccagatgacttcgagggggtctgcaccattctggaatggctgtcatttataccgaaggacaatcgcagcccggtccccatcaccactccttctgaccccatcgacagggaaattgaattcaccccaaccaaagctccctacgaccccaggtggatgcttgcaggcaggcctcacccaactctgaaggggacctggcagagtggattcttcgaccatggcagtttcaaggaaatcatggcaccctgggcccagactgtggtgacgggacgagcaaggctggggggcatccctgtgggagtgattgctgtggagactcggactgtggaggtggctgtccccgctgaccctgccaacttggattctgaggccaagatcatccagcaggcgggccaggtgtggttcccggactcggcctacaagacggcgcaggtcatcagggacttcaacaaggagcgcctgcctctcatgatcttcgccaactggaggggcttctccggaggcatgaaggacatgtatgagcagatgctgaagtttggcgcctacatcgtggatggtctccgcctgtacgagcagcccattctcatctacatccctccctgtgcggagctccgtgggggctcctgggttgtcctggactccaccatcaaccccctgtgcatagagatgtatgcagacaaagagagcagggggggtgttctggagccggagggcacggtggagattaagttccggaagaaagatctggtgaaaaccataaggaggatagacccagtgtgtaagaagctcgtgggacagctggggaaagcccagcttcccgacaaggaccggaaggagctggagggccagctgaaggcccgggaggaactgctgcttcccatctaccaccaggtggcagtgcagttcgcagacctgcacgacaccccgggccacatgctggagaaaggaatcatttctgatgtgctggaatggaagactgcccgcaccttcttctactggaggctgcgccggctgctgctggaggcccaggtgaagcaggagatactccgagccagccccgagctgaaccacgagcacacacagtccatgctgcgacgctggttcgtggagactgagggcgctgtcaaggcctacctgtgggacagcaaccaggtggtggtccagtggctggaacagcactggtcagccaaggacggcttgcgctccaccatccgtgaaaacatcaattatctgaagcgggactctgtcctcaagaccatccaaagtctggtccaagaacatccagaggtcatcatggactgcgtggcctacctgagccagcacctcacgccagccgagcggatacaggtggctcagctgctgtctaccacggagagcccagcttcctcctgatgagcaactctggccatccccaggaccctggacggtgggatggccatgcggcaggccttcgagggacacgggcttattttgggaaaactcacggagccactccaaatgtagctgcggttcctgaccagcgacttctggacagaaggcccctgggcccctgctaaggcgggcccagcctctcctcacctggggacttcagggtttgtcccagtggataattctgccactgcctctctgaggccaactgaaccaggcacaccgagttccttgtggtttttgcctgaggtggggatccggtgtctgatcacaagacacttgttctaccacgttggtttgcactcagctccttgtgtccctcagccgagtaaatgggccaaagagaacgccagatgagacccaagaaaacgtctttttgtgatgaggcttattagacacttagcaagagcaaaaatgatttccttttttgttgttgttgttgtttttcatttaagagaataaagtgacattttattctccaagtggccctagtgagtcaggacaaccatctgtcccattagagaggttctccagagataaaggacaaacagacaggacacctagcattcagcatggctggaggagagttactgcctcggttcccaggctctgtaagccctctcttcccaagtggagcaaggactggacctccgtgcctcctgcagattggccacccacagggtactgagtgccctactgcctgagtgcagagaggctgtccctcacccctcccagaacctctggccaatatacttcctcaccttgtgccttgataccacggcaggagccaacagcgctggaccagtgacccagggctgtgcctcgaacactctggatccgcttacagagactttcccagcactgccaggcaccgcagcatcaggacccgaatgagatgctccggccaggggtggggtggggatgttggggtagtggagaaccccactctgtcgctgcccttcttgggggataaagggttcttctgggcaaggtcctcttgatgtggaggaaagcccagaccgacactggctgccaccctgaccacttgggtgcgctgaagaggctgctgaaagagctgcaaaataaactattttttttgaagaaaaaaaaaaaa

SEQ ID NO: 232 - DNA, 533 bp, Homo sapiens
tgctcagttcatccctagaggcagctgctccaggaacagaggtgccatgcagccccgggtactccttgttgttgccctcctggcgctcctggcctctgcccgagcttcagaggccgaggatgcctcccttctcagcttcatgcagggttacatgaagcacgccaccaagaccgccaaggatgcactgagcagcgtgcaggagtcccaggtggcccagcaggccaggggctgggtgaccgatggcttcagttccctgaaagactactggagcaccgttaaggacaagttctctgagttctgggatttggaccctgaggtcagaccaacttcagccgtggctgcctgagacctcaataccccaagtccacctgcctatccatcctgcgagctccttgggtcctgcaatctccagggctgcccctgtaggttgcttaaaagggacagtattctcagtgctctcctaccccacctcatgcctggcccccctccaggcatgctggcctcccaataaagctggacaagaagctgctatg

SEQ ID NO: 233 - DNA, 524 bp, Mus musculus
ctgctcagttttatccctagaagcagctagctactccaggtacgtaggtgccatgcagccccggacgctcctcactgtggccctcttggctctcctggcatctgcccgagctgaagaggtagagggatccttgctgctgggctctgtacagggctacatggaacaagcctccaagacggtccaggatgcgctaagtagcgtgcaggagtccgatatagctgtggtggccaggggctggatggacaatcacttcagatccctgaaaggctactggagcaagtttactgacaagttcaccggcttctgggattctaaccctgaggaccaaccaactccagctattgagtcgtgagacttctgtgttgcagatgtgcctgttcctccatcctgctgcccccctccaggcctgccaggtggcccctgaaggttgctttaaggggaaagtatgttctcatgtcttcacccctccctagatctcacctaaacatgctgtccctaataaagctggataagaagctgctgtt

SEQ ID NO: 234 - DNA, 4093 bp, Homo sapiens
tttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatcaaaa

SEQ ID NO: 235 - DNA, 4272 bp, Mus musculus
ggtctgggcctgggttttgcgggaatggttagtggctaccgcgaggcgtttttcccggtcaagcgttgcatttctacccacaggcctgtgtaagctcgggtctcgaggcgaagatcgccccactgaaagaaattgaaatgcgaaacagacgaaatgctcttatttttttctgcgttgagaggatgatctagtattgcccaacgtacttctaatttatggtctcactgaatctggagaggaactactggctagacgtgttggccagcaagtccccaggacctcactgcttcttcatattcatctggtttgcagtgttaaccgattaacctgggtcaagaggaaatgacagtcgtgatggggaaatgtcaagtatcagatggacgccagcttttgttattttatgccgtgctgttactctttcctactttgtgtgccatgcaaaatagcggtcacacaactggcctctcattaaataatgagcggctatacaagctcacgtactccactgaagtgtttcttgatgggggcaaaggaaaaccgcaagacagcgtgggctacaaaatctcatctgatgtggacgttgtgttactgtggaggaatcctgatggtgatgatgatcaagtgatccaagtcacgataacagctgttaacgttgaaaatgcgggtcaacagagaggcgagaagagcatcttccagggcaaaagtacacctaagatcatagggaaggacaacctggaggctctgcagagacccatgcttcttcatctggtccgggggaaggtcaaggagttctactcctatgaaaacgagccagtgggcatagaaaatctcaagagaggcttggctagcttattccagatgcagctaagctctggaactaccaacgaggtagatatctctggggattgtaaagtgacctaccaggcccagcaagacaaagtggtcaaaattaaggctctggatacatgcaaaattgagcggtctggatttacaacggcaaaccaggtgctgggtgtcagttcaaaagccacatctgtcactacctacaagatagaggacagctttgtcaccgctgtgcttgcagaagagaccagggcttttgccttgaacttccaacaaaccatagcaggaaaaatagtgtcgaagcagaaattggagctgaagacaactgaagccggcccaaggatgatccccgggaagcaagtggcaggtgtaattaaagcagttgattccaaatacaaagccattcccattgtgggacaggtcctcgagcgtgtctgcaaaggatgcccttctctggcggagcactggaagtccatcagaaagaacctggagcctgaaaacctgtccaaggccgaggccgtccagagcttcctggccttcattcagcacctccggacttcgaggagagaagagatcctccagattctgaaggcagagaagaaagaagtgctccctcagctggtggatgccgtcacctctgctcagactccagactcgctagaagccatcctggactttttggatttcaaaagtgacagcagtatcatactccaggaaaggttcctctatgcctgtggctttgccacccaccctgatgaagaactcctacgagccctccttagtaagttcaaaggttcctttgcaagcaacgacatcagagagtcggttatgatcatcattggagccctggtcaggaagctgtgtcagaatgaaggctgcaagctcaaggcagtggtggaagctaagaagctgatcctgggaggacttgaaaaaccagagaagaaagaagacaccacaatgtacctgctggccctgaagaatgccttgcttcccgaaggcatcccgctccttctgaagtatgctgaggctggagaagggcccgtcagccacctggccaccactgttctccagagatacgatgtctccttcatcacagatgaggtgaagaagaccttgaacaggatataccaccagaatcgtaaggttcatgagaagacggtgcgcacaactgccgctgctgtcatcttaaagaacccatcctacatggatgtgaagaacatcctgctgtccattggggaactcccgaaagagatgaacaaatacatgctcactgttgtgcaagacatcctgcattttgaaatgcctgcaagcaaaatgatccgtcgagttctcaaggagatggctgttcacaattatgaccgtttctccaagagtggatcctcttctgcctatactggctacgtagaacgtagcccccgtgcagcgtccacatacagccttgacatcctttactctggctctggcattctgaggagaagtaacctgaacatcttccagtacatcgggaaggcagagcttcatggtagtcaggtggtgattgaagcccaagggctggaaggcttaattgcagccactcctgatgaaggagaggagaaccttgactcttatgctggcatgtcagccatcctgtttgatgttcagcttaggcctgtcacattttttaatggatacagtgatttgatgtccaaaatgctgtcggcatccggcgaccctgtcagcgtggtgaaagggcttattctgttaatagaccattctcaggatattcagctgcaatctggactaaaggccaatatggagatccagggtggtctagctattgatatttctggttcaatggaattcagtctgtggtatcgagagtctaaaacccgagtgaaaaatcgggtggctgtggtgataaccagcgacgtcacagtggatgcctcttttgtgaaagctggtgtggaaagcagagcggagacagaggctgggctggagttcatctccacagtgcagttctcacagtacccgttcttggtctgcatgcagatggacaaggctgaagccccactcaggcaattcgagacaaagtatgaaaggctatctacaggcaggggatatgtctctcggagaagaaaagagagcctagtggccggatgtgaactccccctccatcaagagaactctgagatgtgcaacgtggtattcccacctcagccagaaagcgataactccggtggatggttttgattcccgtgggttcccttccaccagaacgatatgctttgacgtgcctgacccttgctctctgagagcacagtgtttacatatttacctgtatttaagatgtttgtaaagagcagtggagaacttcagttgattaaagttgaacctattcaggagaagacccacagtgtccctctgagtcaccatatgacacttagcaacatgcctacttcttgtactttgcaaaagtcctaactagtacagtgagtctagttttgcattgagaaactagtatttgtataaaaacaaaacaaaaacccacaccataaaagcttaggtaaatgtgaattttattcaacatcttttcagtgaaagtgaatccttgatagacccctaagctcgttttctatgaagcccactgcctaagaagggccggggtgaaaggaacccaagcaaaccatttttcttttgttgttgttgttttgttttgtttgcttttcttctctttcttttacttttttttcccccttctggtgtatatgggaaggttctaagaaaggatacagataagacttaaaagaattttgttagtcaatcttaagaattaatatttatgttttctgatagttttataagcgacaaggcgagagacggaattaaaatgtactgtgacatctctctgctggccccacagtgagaccacttggaagtcattcacccttttaaaaaactggaactgtcatacagggataaaaattattgagcctcagagcatccattagatttttctctggatgtgtctttttgatagtgtaatgtggtacatggttctttgtaggggacacccttgtagctaccactctatctatacctcaattgttggaaataatccatcaatttgactgcaatttatgcagtcaataaaagttgggatgatcattgcttaaaaaatgatggatttgtatttcaaaactatgaaattaaataaaaaccatgtctatttgtgtgaattaaaaggccacaccaagcatttaaacatatttattagtaaagcagatgtgtttattatagtacctcaccacccccccccccccaatgccaggtacttgttagtccactaaacaaatgggagtttaaaatggaagtggaaacacacgaagtggacgtttagctgaggtagaaaataaattgtgatgatgacaaataaacatttataatttactg

SEQ ID NO: 236 - DNA, 6318 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 237 - DNA, 6464 bp, Mus musculus
gtcatgtgactggggactgtagtaagacaggtgccttcagttcactctcagtaaggggctggttgcctgcatgagtgtgtgctgtgtgtcagagtggattggagttgaaaaagcttgactggcgtcattcgggagctggatggcttgggacatgtgcagccaagactctgtatggagtgacatagagtgtgctgctctggttggtgaggaccagcctctttgcccagatcttcctgaacttgacctttctgaacttgatgtgaatgacttggatacagacagctttctgggtggattgaagtggtgtagcgaccaatcggaaatcatatccaaccagtacaacaatgagcctgcgaacatatttgagaagatagatgaagagaatgaggcaaacttgctagcggttctcacagagacactggacagtctccccgtggatgaagacggattgccctcatttgatgcactgacagatggagccgtgaccactgacaacgaggccagtccttcctccatgcctgacggcacccctccccctcaggaggcagaagagccgtctctacttaagaagctcttactggcaccagccaacactcagctcagctacaatgaatgcagcggtcttagcactcagaaccatgcagcaaaccacacccacaggatcagaacaaaccctgccattgttaagaccgagaattcatggagcaataaagcgaagagcatttgtcaacagcaaaagccacaaagacgtccctgctcagagcttctcaagtatctgaccacaaacgatgaccctcctcacaccaaacccacagaaaacaggaacagcagcagagacaaatgtgcttcgaaaaagaagtcccatacacaaccgcagtcgcaacatgctcaagccaaaccaacaactttatctcttcctctgaccccagagtcaccaaatgaccccaagggttccccatttgagaacaagactattgagcgaaccttaagtgtggaactctctggaactgcaggcctaactcctcccacaactcctcctcataaagccaaccaagataaccctttcaaggcttcgccaaagctgaagccctcttgcaagaccgtggtgccaccgccaaccaagagggcccggtacagtgagtgttctggtacccaaggcagccactccaccaagaaagggcccgagcaatctgagttgtacgcacaactcagcaagtcctcagggctcagccgaggacacgaggaaaggaagactaaacggcccagtctccggctgtttggtgaccatgactactgtcagtcactcaattccaaaacggatatactcattaacatatcacaggagctccaagactctagacaactagacttcaaagatgcctcctgtgactggcaggggcacatctgttcttccacagattcaggccagtgctacctgagagagactttggaggccagcaagcaggtctctccttgcagcaccagaaaacagctccaagaccaggaaatccgagcggagctgaacaagcacttcggtcatccctgtcaagctgtgtttgacgacaaatcagacaagaccagtgaactaagggatggcgacttcagtaatgaacaattctccaaactacctgtgtttataaattcaggactagccatggatggcctatttgatgacagtgaagatgaaagtgataaactgagctacccttgggatggcacgcagccctattcattgttcgatgtgtcgccttcttgctcttcctttaactctccgtgtcgagactcagtgtcaccaccgaaatccttattttctcaaagaccccaaaggatgcgctctcgttcaagatccttttctcgacacaggtcgtgttcccgatcaccatattccaggtcaagatcaaggtccccaggcagtagatcctcttcaagatcctgttactactatgaatcaagccactacagacaccgcacacaccgcaattctcccttgtatgtgagatcacgttcaaggtcaccctacagccgtaggcccaggtacgacagctatgaagcctatgagcacgaaaggctcaagagggatgaataccgcaaagagcacgagaagcgggagtctgaaagggccaaacagagagagaggcagaagcagaaagcaattgaagagcgccgtgtgatttacgttggtaaaatcagacctgacacaacgcggacagaattgagagaccgctttgaagtttttggtgaaattgaggaatgcaccgtaaatctgcgggatgatggagacagctatggtttcatcacctaccgttacacctgtgacgctttcgctgctcttgagaatggatatactttacgcaggtcgaacgaaactgacttcgagctgtacttttgtggacggaagcaatttttcaagtctaactatgcagacctagataccaactcagacgattttgaccctgcttccaccaagagcaagtatgactctctggattttgatagtttactgaaggaagctcagagaagcttgcgcaggtaacgtgttcccaggctgaggaatgacagagagatggtcaatacctcatgggacagcgtgtcctttcccaagactcttgcaagtcatacttaggaatttctcctactttacactctctgtacaaaaataaaacaaaacaaaacaacaataacaacaacaacaacaacaataacaacaacaaccataccagaacaagaacaacggtttacatgaacacagctgctgaagaggcaagagacagaatgataatccagtaagcacacgtttattcacgggtgtcagctttgctttccctggaggctcttggtgacagtgtgtgtgcgtgtgtgtgtgtgggtgtgcgtgtgtgtatgtgtgtgtgtgtacttgtttggaaagtacatatgtacacatgtgaggacttgggggcacctgaacagaacgaacaagggcgaccccttcaaatggcagcatttccatgaagacacacttaaaacctacaacttcaaaatgttcgtattctatacaaaaggaaaataaataaatataaattaaaaggaaagaaaactcacaaaccaccctaaaatgacactgctgatgcctgttgtcagcctccggtaccgtcttttcagaaagtgcaaaacccagaaagtgcaaaaccaacctgcagcaagctctctctctctcttaatgtaatcattacgtgacaatcccgaagacactacaggttccatagaactcatatccacctctctctctctctctctctctctctctctctctctctctctcctctctcctctctcctctctccctcccttctttgccattgaatctgggtgggagaggatactgcaggcaccagatgctaaactttcctaacattttgaagtttctgtagtttgtcctttgtcctgacacctatgtatatgttcaaaatgttgatcttccactgcagattttgaaaagccttgttattggtcaagcggggagtgtgttcagtggctccttctgaggagcagacgcggtgttacatgagtactgagagttgagtagaactctctggatgtgttcagatagtgtaattgctacattctctgatgtagttaagtatttacagatgttaaatggagtatttttattttatgtacatactctacaactatgttcttttttgttacagctatgcactgtaaatgcagccttcttttcaaaactgctaaatttttcttaatcaagaatattcaaatgtaattatgaggtgaaacaattattgtacactaacatatttagaagctaaacttactgcttatatatatttgattgtaaaaaaaaaaaaaaacaaaaccaacaaaacaaaagacagtgtgtgtgtgtgtgtccgttgagtgcaagtccaacaaaatggcgcttcacgcacatccatcccttcttaggtgagcttcaatctaagcatcttgtcaacaacaacaaaaatcctaggcccctcaaggtattaaccacttctgcaatatttttccacattttcttgttgcttgtttttctttgaagttttatacactggatttgttaggggaatgaaattttctcatctaaaatttttctagacaatatcatgattttatgtaaagtctctcaatggggaaccattaagaaatgtttttattttctctatcaacagtagatttgaaactagaggtcaaaaaaaatctttttaaaatgctgttttgttttaatttttgtgattttaatttgatacaaaatgctgaggtaataattacagtatgatttttacaatagtcaatgtgtgtctgaagactatctttgaagccagtatctctttcccttggcagagtatgatgatggtatttaatctgtattttttacagttatacatcctgtaaaatactgatatttcattcctttgtttactaaagagacatatttatcagttgcagatagcctatttattataaattaagagatgatgaaaataataaggtcagtggagactttctacccagggtgcatggcagttgtcaggctggagtgtaccttcttcgtttgggaaactcagctctcgcagaagcagtgttccatctttcactagcatggcctctgatacgaccatggtgttgttcttggtgacattgcttctgctaaatttaatattaataataataaatgtcagaaaaaaaaccctccattttgagcatcaggatttcatctgagtatggagtcgctgccatgggagtcactaaactttggagtatgtatttcatttccaaattgagatgcatttactgtttggctgacatgaattttctggaagatatgatagacctactacttaaccgtttttgtttgtttttttttctttgttgttgttgttttgttttttgtttttttgtttttctctctcacccaacactatcttacaaaatgggtttcacccccaggccaatgcagctaattttgacagctgcattcatttatcaccagcatattgtgttctgagtgaatccactgtctgtcctgtcgaatgcttgctcaagtgtttggcttattatttctaagtagatagaaagcaataaataactatgaaataaaaaagaattgtgttcacaggttctgcgttacaacagtaacacatctttaatccgcctaattcttgttctgtaggataaatgcaggtattttaactctttgtgaacgccaaactaaagtttacagtctttctttctgaattttgagtatcttctgttgtagaataataataaaaagactattaagagcaataaattatttttaagaaatcaatatttagtaaatcctgttatgtgtttaaggaccagatgcgttctctattttgcctttaaatttttgtgatccaactttaaaaacatacgttgtcttgtttgccctggatcatggacatgactaaaattttgtggtttcttttcttacttatcaaaagacaacactacagatttcatgttgaggattcattgagctctcaccctctggcctgacaaatcttgttaccatgaagatagttttcctccgtggacttcaaattgcatctaaaattagtgaagcttgtgtatcttatgcagacactgtgggtagcccatcaaaatataagctgtaagctttgttcctttcatttttttttttttacttcttttgggagagaatatttccaacaaacacatgcaccccaccaacaggggaggcaaatttcagcatagatctataagactttcagatgaccatgggccattgccttcatgctgtggtaagtactacatctacaattttggtacccgaactggtgctttagaaatgcggggtttttattaaaaaaaaaaaaaagaaatgtagcagaataattcttttagtgcagcaactcagtttttgtaaaggactctgagaacacttgggctgtgaacattcaaagcagcagagagggaacctggcactattggggtaaagtgtttgggtcagttgaaaaaaaggaaaccttttcatgcctttagatgtgagctaacagtaggtaatgatcatgtgtccctttttgatggctgtacgaagaacttcaatcactgtagtctaagatctgatctatagatgacctagaatagccatgtaatataatgtgatgattctaaatttgtacctatgtgacagacattttcaataatgtgaaaactgcagatttgatggagctactttaagatttgtaggtgaaagtgtgctactgttggttgaactatgctgaagagggaaagtgagtgattagtttgagcccttgctggctcttttccacctgccaattctacatgtattgttgtggttttattcattgtatgaaaattcctgtgatttttttttaaatgtgcagtacacatcagcctcactgagctaataaagggaaaagaatgtttcaaatcta

SEQ ID NO: 238 - DNA, 10642 bp, Homo sapiens
ctcctccctcctcccttgctcgctcgctggctccctccccccgggccggctcggcgttgactccgccgcacgctgcagccgcggctggaagatggcggggaacgactgcggcgcgctgctggacgaagagctctcctccttcttcctcaactatctcgctgacacgcagggtggagggtccggggaggagcaactctatgctgactttccagaacttgacctctcccagctggatgccagcgactttgactcggccacctgctttggggagctgcagtggtgcccagagaactcagagactgaacccaaccagtacagccccgatgactccgagctcttccagattgacagtgagaatgaggccctcctggcagagctcaccaagaccctggatgacatccctgaagatgacgtgggtctggctgccttcccagccctggatggtggagacgctctatcatgcacctcagcttcgcctgccccctcatctgcaccccccagccctgccccggagaagccctcggccccagcccctgaggtggacgagctctcactgctgcagaagctcctcctggccacatcctacccaacatcaagctctgacacccagaaggaagggaccgcctggcgccaggcaggcctcagatctaaaagtcaacggccttgtgttaaggcggacagcacccaagacaagaaggctcccatgatgcagtctcagagccgaagttgtacagaactacataagcacctcacctcggcacagtgctgcctgcaggatcggggtctgcagccaccatgcctccagagtccccggctccctgccaaggaggacaaggagccgggtgaggactgcccgagcccccagccagctccagcctctccccgggactccctagctctgggcagggcagaccccggtgccccggtttcccaggaagacatgcaggcgatggtgcaactcatacgctacatgcacacctactgcctcccccagaggaagctgcccccacagacccctgagccactccccaaggcctgcagcaacccctcccagcaggtcagatcccggccctggtcccggcaccactccaaagcctcctgggctgagttctccattctgagggaacttctggctcaagacgtgctctgtgatgtcagcaaaccctaccgtctggccacgcctgtttatgcctccctcacacctcggtcaaggcccaggccccccaaagacagtcaggcctcccctggtcgcccgtcctcggtggaggaggtaaggatcgcagcttcacccaagagcaccgggcccagaccaagcctgcgcccactgcggctggaggtgaaaagggaggtccgccggcctgccagactgcagcagcaggaggaggaagacgaggaagaagaggaggaggaagaggaagaagaaaaagaggaggaggaggagtggggcaggaaaaggccaggccgaggcctgccatggacgaagctggggaggaagctggagagctctgtgtgccccgtgcggcgttctcggagactgaaccctgagctgggcccctggctgacatttgcagatgagccgctggtcccctcggagccccaaggtgctctgccctcactgtgcctggctcccaaggcctacgacgtagagcgggagctgggcagccccacggacgaggacagtggccaagaccagcagctcctacggggaccccagatccctgccctggagagcccctgtgagagtgggtgtggggacatggatgaggaccccagctgcccgcagctccctcccagagactctcccaggtgcctcatgctggccttgtcacaaagcgacccaacttttggcaagaagagctttgagcagaccttgacagtggagctctgtggcacagcaggactcaccccacccaccacaccaccgtacaagcccacagaggaggatcccttcaaaccagacatcaagcatagtctaggcaaagaaatagctctcagcctcccctcccctgagggcctctcactcaaggccaccccaggggctgcccacaagctgccaaagaagcacccagagcgaagtgagctcctgtcccacctgcgacatgccacagcccagccagcctcccaggctggccagaagcgtcccttctcctgttcctttggagaccatgactactgccaggtgctccgaccagaaggcgtcctgcaaaggaaggtgctgaggtcctgggagccgtctggggttcaccttgaggactggccccagcagggtgccccttgggctgaggcacaggcccctggcagggaggaagacagaagctgtgatgctggcgccccacccaaggacagcacgctgctgagagaccatgagatccgtgccagcctcaccaaacactttgggctgctggagaccgccctggaggaggaagacctggcctcctgcaagagccctgagtatgacactgtctttgaagacagcagcagcagcagcggcgagagcagcttcctcccagaggaggaagaggaagaaggggaggaggaggaggaggacgatgaagaagaggactcaggggtcagccccacttgctctgaccactgcccctaccagagcccaccaagcaaggccaaccggcagctctgttcccgcagccgctcaagctctggctcttcaccctgccactcctggtcaccagccactcgaaggaacttcagatgtgagagcagagggccgtgttcagacagaacgccaagcatccggcacgccaggaagcggcgggaaaaggccattggggaaggccgcgtggtgtacattcaaaatctctccagcgacatgagctcccgagagctgaagaggcgctttgaagtgtttggtgagattgaggagtgcgaggtgctgacaagaaataggagaggcgagaagtacggcttcatcacctaccggtgttctgagcacgcggccctctctttgacaaagggcgctgccctgaggaagcgcaacgagccctccttccagctgagctacggagggctccggcacttctgctggcccagatacactgactacgattccaattcagaagaggcccttcctgcgtcagggaaaagcaagtatgaagccatggattttgacagcttactgaaagaggcccagcagagcctgcattgataacagccttaaccctcgaggaatacctcaatacctcagacaaggcccttccaatatgtttacgttttcaaagaaatcaagtatatgaggagagcgagcgagcgtgagagaacacccgtgagagagacttgaaactgctgtcctttaaaaaaaaaaaaaatcaatgtttacattgaacaaagctgcttctgtctgtgagtttccatggtgttgacgttccactgccacattagtgtcctcgcttccaacgggttgtcccgggtgcacctcgaagtgccgggtccgtcacccatcgccccttccttcccgactgacttcctctcgtagacttgcagctgtgttcaccataacatttcttgtctgtagtgtgtgatgatgaaattgttacttgtgaatagaatcaggactataaacttcatttttaattgaaaaaaaaagtatatccttaaaataatgtatttatggctcagatgtactgtgcctgggattattgtattgcttccttgattttttaactatgcactgtcatgaggtgtttgccactgagctgccctgctccccttgccagattgccctggaggtgctgggtggccgctaggctggtctgcaggaaagcgcggcctgccgtttccgggccgtatctgccaagccctgccttgtctcttactgagcaagtttggctcaaattataggagcccccatcttgtgcccagctcatgctccaagtgtgtgtctatccatttgtactcagactcttgagtaccttgtaaggaaggcggggcaagctgcatcattcctgttttccaggggaggctggcagctcctcaagaggcgaaatgactgtgggaggtccggttaccagtgaggaggcagagcggtgacccagaccaggccttctggttcttggtcccgtgcttccgtagtagctggggtaaagacaccgtttcagggactggtagaggtgagttcggctaaattgggcaccgggctagaagcctaagggctcattttaggggttacattaggtgttgattcaccagcatcaggtgaattcaagccctggcatgtgtcttggatgcaccatcagctttgatcctgagtggtcctgcggtttgtctgtgcctgtggacacactgtcagaacttcagtgacacccctggcagcggtacagacaggtggtctgggagcagtcatcttttttgggccagccaccagcccatcctactccctcaggtagtccttcgtctttaccttgtccttgtctgtaaagttgttttggtggctggggcaggggagccaggaggagggagtgaaggttgggaatagataggacaatctcctagctctcctccaattgagaaaacactccaattgggctttgctttaaactttgtgttcttaagtgatgtcaaagccatttccagcttaatgttctgtgggtaccttgggggccattcatgcagggagcatggccaggcagggtatgagtacattgtttctgatttctttcatacatcagggttcctcgggaaatttttgtattttttttttaagtcctgctgctttaaaaatttgaaagtggctcattaaactaaacaggctaatgtaatttgttgcttatgccaagcctagactgttgagaattgacgtttttaaagattatcaaatacctcagtaggtaaaatgagcccatgatcttccactgagtggtgagcatactcccagcccatggacaaggccggaagagacaggctttagtaggggtagggaatttgaactgttgtgtgtcacagcagttgacctctctggactccaatttcctttcctgtgaaatgaactgattagacatgtttcaacattgttagcttctgctgaggcagtgtctagcccaagatggcaaatacatagctcatgtgccactactcccacctccttgaccaatacagacataactaatcaatcacaccactcaggttccctgagcctggatgtgctataagaatcctgaaatcagtgctctggtaagtcattactaattgattagagttcaatctatttgacatcttgggctaatctttggaaggtttccaacaatcacacaaaaccatatgctggctgggtttcatgctggcctatccctgtctgtgatgttccgttccatgagagaaaactcccctaatgctattccatggcgtaacactcccaatactattttgacgcccacgtccccttgcagagggtgcagggggcggtagacgaatgacagacaggaacatatttggggaaggcagggcttaggaagatggaccaaaaagggacttcccacagcacagacctgatcattcggatttcctctttagctattcactgcctagcacatagtaggcacacaataaatgattatggaatgggataaaatttagatctttctgctgcctccactaagttaagtcctgatttacatcaaggagagaactgagataggaaagaacactagattccaagtctggagagttgggggagtccagattctaccaagaatttcctttgtaactttggtaagtcccttttactccctggcaccccggtgtgctgaaaggagttggtccatatatgatctcttagcccctcctatttgcttcttccttgattgctcttggtcaaagggtcagccttgggctggtgatactttagagtaaagaaatggagagttttagcaaaggaccagtctgtccctccctgctttggggtcagctaaagctgtcctttcatgtcagattaacctaggacacttgtagttagcttagacgttggcccttgagcagagacctgagcgtggcattgggacatgacatacctaaagtcagggctaggggacgctgcctgccaagggcatcgagtagtctctacttgctatcccgtacataaaatgctacaagttctaaaatttaccgaccctgcagacaacctctatcccgaaggactcattcggtgctgtgtattatttagggcaactccaaggtctattcagaaaaacgagtgaaccttggtctctttcccaccaaattgaggagtaacccagagggagcagctgccattggcaaccatctcgttgtagctctgtcctagtgtttgctcttgatgatgtttacatgtgatcgccataaagcttgctgtagactgtgtcgatagccgcccgcacagggcaggtcgtactgtccgtttctgtgccgtgctggtgttttccaaaaatgtctgatccaaccactaagtggaattcttccatctccttcctcagtctgtacaaggctgaatcagaatccccattctcgggggctctggttaccgaaggaaaatgcatcaaagagttaaagaatatgagtggatggagtgcagctaaggcccccaccccctgctccgtcacaacttgccccctcaaccaaaaagctgctttgagtcaaaaagcacccataagatacctgcatctgccttgaaatcttgcagcatggagtgtcatatgtactcaggagagaggcagggctttgcgggcaggagaaggaagggaggaatgctctgagctgcaaagacccagtactcaagttctgacgtgggaggagatgcagtgagacgtctcttgttgcctaaagcctgttcctgttggttttcttagagtgatttctcctagacatgtgcagtaggcccactggggctgctgtgcagtggtgagtaaaagggcagggaaggcatggacagcctggtccttctgcatggacagctcagtccatggcccatcccaggtatagagttcagttaatcccatttgagcctgcagcttaagagatggctcatcctaactgtgaagcaaaatcagccccagaggatgtattgatctgactcactgatgtcaaaattgcagtatttttttagcatttgagatttagcagctgccttcagtttggggttacccacatcccagcatcagatatgattaaggaaagaaattggatgtacaacagcaaagaaagtgaatgtcatggtttccctggccaaagaagagggaccctgtcatccttaccaatggggaagaagaaaactagtgcatgtgcaatatgtcaaagttagtcccctagtccctgaggggtttttacacacagatgggctccaggtctgctcgtcaagtttggaggtaccgggtaaatggaggggagctgcagagttggaaacccacatgcatggatgtgtccttggcccagaaccaccatgggatgggggaggccctgagccggctacaagacacccaggaagtaggcaaaggctgactttgcattaaacaataaaagcactttgagaaaaccccaacacttcagcctgggtccgtgtttctacactggaaaatacgagtctcctttggctgtgtgaagtgatcttctagagactgggacagggagtttgggaatggggctgctgtcaggtaggagagagcagagatgcctttggagatgtcagcagcaggagagccagtgctggggccaaccctttgctggccttttgttggaagcccttgaaacagggagccatgggtttagatcttggtacctacctttacagaaagatgaaaacagcccagctgagtgaaatgagtttgtagagtaagtcacttaactgtaagccatctcagaatcagaaaccctaatgtttcttacttgctatgtgaccttgggcccctgtttcctcatctaccaaatgagaatgttgaatatgagcattaaagtccctttcacctctgagaggctcagatccccaaccaggagcattgggaatccatcactcctccttgaaactgattccattctctgacttgacccagctcctgttcagggtgagggttctctgcaagaaccaaccagcagtaggttcaatcccactgtgtcctggctgagttgccttatccaagaagaccagctccccgggacagatctaagccatagtttctagtggggacagtaaggaattaaacccccaacttggctaggtaacgatgtcaaatctcacattaaccttgtctttgtccccactggatagctgttaatccgaatgttgtgaccatttggctgtttctctcttgttctcagacaatactagcaatacactttttttttttttttttaaagaaaaacagcttaggagcttttcacacatttctttcaaatgattgtaaaacatatggggcaacaggaggcattgatcgcgctgcatatgtttagggcagcttttgttttttgtttctttaatggtatagcagcagtgactgagccttcgtgattcctggggacagcttttcagatactctgtttcatcagtatgctttgcacatccggaaggagtacaaaaatccaactgcccaaatttggggcttggaaaataggttttataggtggtcggtccctgggctgtgcaacaactcctcaaagaggggtttatataactagaacccccctgggctgtatttttggtcaaaggagtctccaaggcggcttacaaaagcttcctttttcacttgaccacccttgctcattggttacttgtgaagggaattggtcagtttccacctcagcactttgccttatcaacatgcggtcgccatctagtggccaaaggttgtctccaccagctacccagatggaaggcaaataaatcctttcggccaccctgctgtccatcgtgaactttgggaatgaaatataatggcctgaacgaactgcctttgtgttcagagatcagtgcaacactagggtcagaagactccagaagcagccacttagtagactctcacgcagaactgagaaatgcactagctgtcctgtgggcagaagagacaggagtggaccaggagaggtccaggtgcccgggaagggtttactgtaactgcaatactggcagcccagctgctgaccttgttaagtaaacctttgctgggtggtccgaattctgccctcaaggcaagataagaagttgggtgtaaggattttgtggggggcctggccatgatctttgatatgatccccgaatagccaaatagttttttttgttcaattttttgtttctgtattttgtatttttaaaatcttgtcaaatgtttttgtgttaggaataaaaagtcataaactattcccaactttgtttcttgagggatgttctgattccaatggaaacaggtgggaaatctcaaggggagcgtggacaaggtggtatgtgcagcaggggaatagactgcttggatttccaaatggtttctggggaagatgaccatccagaagtccagcttagtgcagtctgctctggaattcacacccaccccctcgcctccttgtgccatgttgttagcattggcttggagcatctgcttcttccagaggcagctgctaatgttgaaaccaacacgagccctctccccaaccccaggtttctaaagaaggtgtctgtagccagccttaatcaactgggcaaggtggtccctatggtcctttccagcatttccaaatcttggactcaaattattttctcttggtgtgaccacacagcctagagaattctgagcaataggagccagggctttccctgactctgcgacagggtcaaaccaaggaatggctaaacctgtgaggttttgtcatccccgggggtactactgtagggggcattatttattaggaagcttaacaaggtaactacggcctgagtgcgtgagtgtaaggctgtgtttgtggtgggggtgtgtgtgtgtgtatctgtgcacacatacacacgtctgtgcctgtgtgtgtgtgtttgtgtgtgtgtgtgtgtgtggaattacattgatgcatttattgagaaaggtgcaagaatttcacctacacagagggacacatctgctttgttatttataatagaaagctaaattttaattttttaaaggacactgctaatgattgagaatcaagtttttagttttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccacaaaaaaaaaaaaaaaa

SEQ ID NO: 239 - DNA, 3656 bp, Mus musculus
ctcgctccctcccccgggcgggctcggcgctgactccgccgcacgctgcagccgcggctggaagatggcggggaacgactgcggcgcgctgctggatgaagagctctcgtccttcttcctcaactatctctctgacacgcagggtggggactctggagaggaacagctgtgtgctgacttgccagagcttgacctctcccagctggacgccagtgactttgactcagccacgtgctttggggagctgcagtggtgcccggagacctcagagacagagcccagccagtacagccccgatgactccgagctcttccagattgacagtgagaatgaagctctcttggctgcgcttacgaagaccctggatgacatccccgaagacgatgtggggctggctgccttcccagaactggatgaaggcgacacaccatcctgcaccccagcctcacctgcccccttatctgcaccccccagccccaccctggagaggcttctgtccccagcgtctgacgtggacgagctttcactgctacagaagctcctcctggccacatcctccccaacagcaagctctgacgctctgaaggacggggccacctggtcccagaccagcctcagttccagaagtcagcggccttgtgtcaaggtggatggcacccaggataagaagacccccacactgcgggctcagagccggccttgtacggaactgcataagcacctcacttcggtgctgccctgtcccagagtgaaagcctgctccccaactccgcacccgagccctcggctcctctccaaagaggaggaggaggaggtgggggaggattgcccaagcccttggccgactccagcctcgccccaagactccctagcacaggacacggccagccccgacagtgcccagcctcccgaggaggatgtgagggccatggtacagctcattcgctacatgcatacctactgcctgcctcagaggaagctgccccaacgggccccagagccaatcccccaggcctgcagcagcctctccaggcaggttcaaccccgatcccggcatccccccaaagccttctggactgagttctctatcctaagggaacttctggcccaagatatcctctgtgatgttagcaagccctaccgcctggccatacctgtctatgcttccctcacacctcagtccaggcccaggccccccaaggacagtcaggcctcccctgcccactctgccatggcagaagaggtgagaatcactgcttcccccaagagcaccgggcctagacccagcctgcgtcctctgaggctggaggtgaaacgggatgttaacaagcctacaaggcaaaagcgggaggaagatgaggaggaggaggaggaagaagaagaagaggaagaagaaaaagaagaggaagaagaggagtggggcaggaagagaccaggtcgtggcctgccatggaccaaactagggaggaagatggacagctccgtgtgccccgtgcggcgctccaggagactgaatccagagctgggtccctggctgacattcactgatgagcccttaggtgctctgccctcgatgtgcctggatacagagacccacaacctggaggaagacctgggcagcctcacagacagtagtcaaggccggcagctcccccagggatcccagatccccgccctggaaagcccctgtgagagtgggtgcggagacacagatgaagatccaagctgcccacagcccacttccagagactcctccaggtgcctcatgctggccttgtcacaaagcgactctcttggcaagaagagctttgaggagtccctgacggtggagctttgcggcacggcaggactcacgccacccaccacacctccatacaagccaatggaggaggaccccttcaagccagacaccaagctcagcccaggccaagacacagctcccagccttccctcccccgaggctcttccgctcacagccaccccaggagcttcccacaagctgcccaagaggcacccagagcgaagcgagctcctgtcccatttgcagcatgccacaacccaaccagtctcacaggctggccagaagcgccccttctcctgctcctttggagaccacgactactgccaggtgctcaggccagaggctgccctgcagaggaaggtgctgcggtcctgggagccaatcggggtccaccttgaagacttggcccagcagggtgcccctctgccaacggaaacaaaggcccctaggagggaggcaaaccagaactgtgaccctacccacaaggacagcatgcagctaagagaccatgagatccgtgccagtctcacaaagcactttgggctgctggagactgctctggaaggtgaagacctggcgtcctgtaaaagcccggagtatgacaccgtatttgaggacagcagcagcagcagtggcgagagtagcttcctgcttgaggaggaggaggaagaggaggagggaggggaagaggacgatgaaggagaggactcaggggtcagccctccctgctctgatcactgcccctaccagagcccacccagtaaggccagtcggcagctctgctcccgaagccgctccagttccggctcctcgtcctgcagctcctggtcaccagccacccggaagaacttcagacgtgagagcagagggccctgttcagatggaaccccaagcgtccggcatgccaggaagcggcgggaaaaggccatcggtgaaggccgtgtggtatacattcgaaatctctccagtgacatgagctctcgggaactaaagaagcgctttgaggtgttcggtgagattgtagagtgccaggtgctgacgagaagtaaaagaggccagaagcacggttttatcaccttccggtgttcagagcacgctgccctgtccgtgaggaacggcgccaccctgagaaagcgcaatgagccctccttccacctgagctatggagggctccggcacttccgttggcccagatacactgactatgatcccacatctgaggagtcccttccctcatctgggaaaagcaagtacgaagccatggattttgacagcttactgaaagaggcccagcagagcctgcattgatatcagccttaaccttcgaggaatacctcaatacctcagacaaggcccttccaatatgtttacgttttcaaagaaaagagtatatgagaaggagagcgagcgagcgagcgagcgagcgagtgagcgtgagagatcacacaggagagagaaagacttgaatctgctgtcgtttcctttaaaaaaaaaaaaacgaaaaacaaaaacaaatcaatgtttacattgaacaaagctgcttccgtccgtctgtccgtccgtccgtccgtccgtgagtttccatgctgttgatgttccactgccacgttagcgtcgtcctcgcttccagcggatcgtcctgggtgcgcctccaagtgctgtcagtcgtcctctgcccctcccacccgactgacttccttctgttagacttgagctgtgttcacataacatcttctgtctgtagagtgtgatgatgacattgttacttgtgaatagaatcaggagttagaaactcatttttaattgaagaaaaaaaaagtatatccttaaaaagaaaaaaaaaaaaacaaatgta

SEQ ID NO: 240 - DNA, 1892 bp, Homo sapiens
ggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 241 - DNA, 1857 bp, Mus musculus
gtgtgacgacaaggtgaccgggctgaggggacgggctgaggagaagtcacactctgacaggagcctgtgagaccaacagcctgacggggtctcggttgaggggacgcgggctgagaagtcacgttctgacaggactgtgtgacagacaagatttgaaagaagcggtgaaccactgatattcaggacatttttaaaaacaagactaccctttactgaaattaccatggttgacacagagatgccattctggcccaccaacttcggaatcagctctgtggacctctccgtgatggaagaccactcgcattcctttgacatcaagccctttaccacagttgatttctccagcatttctgctccacactatgaagacattccattcacaagagctgacccaatggttgctgattacaaatatgacctgaagctccaagaataccaaagtgcgatcaaagtagaacctgcatctccaccttattattctgaaaagacccagctctacaacaggcctcatgaagaaccttctaactccctcatggccattgagtgccgagtctgtggggataaagcatcaggcttccactatggagttcatgcttgtgaaggatgcaagggttttttccgaagaaccatccgattgaagcttatttatgataggtgtgatcttaactgccggatccacaaaaaaagtagaaataaatgtcagtactgtcggtttcagaagtgccttgctgtggggatgtctcacaatgccatcaggtttgggcggatgccacaggccgagaaggagaagctgttggcggagatctccagtgatatcgaccagctgaacccagagtctgctgatctgcgagccctggcaaagcatttgtatgactcatacataaagtccttcccgctgaccaaagccaaggcgagggcgatcttgacaggaaagacaacggacaaatcaccatttgtcatctacgacatgaattccttaatgatgggagaagataaaatcaagttcaaacatatcacccccctgcaggagcagagcaaagaggtggccatccgaatttttcaagggtgccagtttcgatccgtagaagccgtgcaagagatcacagagtatgccaaaaatatccctggtttcattaaccttgatttgaatgaccaagtgactctgctcaagtatggtgtccatgagatcatctacacgatgctggcctccctgatgaataaagatggagtcctcatctcagagggccaaggattcatgaccagggagttcctcaaaagcctgcggaagccctttggtgactttatggagcctaagtttgagtttgctgtgaagttcaatgcactggaattagatgacagtgacttggctatatttatagctgtcattattctcagtggagaccgcccaggcttgctgaacgtgaagcccatcgaggacatccaagacaacctgctgcaggccctggaactgcagctcaagctgaatcacccagagtcctctcagctgttcgccaaggtgctccagaagatgacagacctcaggcagatcgtcacagagcacgtgcagctactgcatgtgatcaagaagacagagacagacatgagccttcaccccctgctccaggagatctacaaggacttgtattagcaggaaagtcccacccgctgacaacgtgttccttctattgattgcactattattttgagggaaaaaaatctgacacctaagaaatttactgtgaaaaagcatttaaaaacaaaaagttttagaacatgatctattttatgcatattgtttataaagatacatttacaatttacttttaatattaaaaattaccacattataaaatt

SEQ ID NO: 242 - DNA, 9965 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 243 - DNA, 7454 bp, Mus musculus
ggagacccacagccactggagagggcacacgctaggaagggcacacgcgtgcgagttttcagggcccgcggaactgtccgccacttcgagtcccctggagcgccgtgcgccggctccgaacattggtgttcgcagctgttttgggggctggagggttcgtggagtcctggaactggagcgacgctgggtcctctggttgtcccctggaggggagggcacacgggcggggacatcggggcgctcccttctcacggcgtggtgcatttgggcgtatctcaccgggaggcgtttcctgagaccctcggggaacttagaggagagccaagttgaagttcaaggccctgccttccctgtgaactgacgtttgtggctggtcaagttcgggaacaagacgttgtcatcacagcttagcgctctgtggcctgcctggccacatccatccaacatggtggacacagagagccccatctgtcctctctccccactggaggcagatgacctggaaagtcccttatctgaagaattcttacaagaaatgggaaacattcaagagatttctcagtccatcggtgaggagagctctggaagctttggttttgcagactaccagtacttaggaagctgtccgggctccgagggctctgtcatcacagacaccctctctccagcttccagcccttcctcagtcagctgccccgtgatccccgccagcacggacgagtcccccggcagtgccctgaacatcgagtgtcgaatatgtggggacaaggcctcagggtaccactacggagttcacgcatgtgaaggctgtaagggcttctttcggcgaactattcggctgaagctggtgtacgacaagtgtgatcggagctgcaagattcagaagaagaaccggaacaaatgccagtactgccgttttcacaagtgcctgtctgtcgggatgtcacacaatgcaattcgctttggaagaatgccaagatctgaaaaagcaaaactgaaagcagaaattcttacctgtgaacacgacctgaaagattcggaaactgcagacctcaaatctctgggcaagagaatccacgaagcctacctgaagaacttcaacatgaacaaggtcaaggcccgggtcatactcgcgggaaagaccagcaacaacccgccttttgtcatacatgacatggagaccttgtgtatggccgagaagacgcttgtggccaagatggtggccaacggcgtcgaagacaaagaggcagaggtccgattcttccactgctgccagtgcatgtccgtggagaccgtcacggagctcacagaatttgccaaggctatcccaggctttgcaaacttggacttgaacgaccaagtcaccttgctaaagtacggtgtgtatgaagccatcttcacgatgctgtcctccttgatgaacaaagacgggatgctgatcgcgtacggcaatggctttatcacacgcgagttccttaagaacctgaggaagccgttctgtgacatcatggaacccaagtttgacttcgctatgaagttcaatgccttagaactggatgacagtgacatttccctgtttgtggctgctataatttgctgtggagatcggcctggccttctaaacataggctacattgagaagttgcaggaggggattgtgcacgtgcttaagctccacctgcagagcaaccatccagatgacaccttcctcttcccaaagctccttcaaaaaatggtggaccttcggcagctggtcacggagcatgcgcagctcgtacaggtcatcaagaagaccgagtccgacgcagcgctgcacccactgttgcaagagatctacagagacatgtactgatctttcctgagatggcaggccgttgccactgttcagggacctccgaggcctgcggccccatacaggagagcagggatttgcacagagggcctccctcctacgcttggggatgaagagggctgagcgtaggtaatgcgggctctccccacatcctttctgaatgggcacttctaagactacctgctaccgaaatgggggtgatcggaggctaataggattcagacagtgacagacaacggcagtccccagtctggtcttaaccggcccaatgttaatcaatgcacagcactctacgttgcgtttataattcgccattaattaacgggtaacctcaaagtctgagcggtctgttcccttcctgccacccttctggctatgtgcactctcttaaatccctgaaaactaatctgcactttttaacctttgaaaacctacaagtcaaggtgtggcccaaggttagccatttaaatgtggcaaaaaaaaaaaaaaatgtttattgggaagacttcacttgagtttcctggctctaagaaagagagctggcttctgagaacattcgagaatagtttgataagctatcccatcactctctctgtgggctcactgttctggagggtgtaactgactcatgagggtggggatggggggtggggagcattttcagatttgtgtagaagattcccagaaagttacatcttcaagaagccctcagaaggcctccgctagtgtccgatagacaaagacaggatgagccctgagcaggtagttctgcacctctgttcatgtcagaccctcagcgtgtgggcatggcagcaatatcagaggtagattcacaaaagatttgtaaatgctcctctaggcccctcctttggcagctcctttgatatgatactttactgctttgtaaaaaacaaaaacaaaaacaaacaaacaaaaaaaaacctctcttggtgatgagatgcgctctctctatctctctggagtagagaaggcaaaagtgacttcgctatccaggcagaagggagctggtcgccttggagaacaagagacgagggtgtgatttcatccagcttctgtttgtacccagcagaagagctcacaacacttggttggtctgtggttattgttgttgttgttgttattgttgttgtttcaaagaattaggtggtaaagtcccttttcctcagtccctggggaaagcagtgctggctaccttcaaaagaaacagttgcacaaaggagtctcagacctcatggactcccggcacccaccctccaagggggtggctacatatttcagagcaggttgcaccttctacgctcccgacccatctttagaaaactggccatcttctgacgtcatcatcatttgtgattaaagaatgatccagatggacactgccaaggagtcgaggatgtagcccagtggatggaggggcttggttcctggtgccgatttatggacatggtggtagatgcctgcaaccccagcagaagtcagaggtcgccttcagatacataattaagtgggatgctagtctgtgccgtgtgagaccctgtttaaaagagaaaaagattgctgctgacgaaatgttcaaggtcagcattatgaaaacactaataagaataataataagggaaaattagcattgggacatactttaagatttgcacccttactgaccttccccactccctcctgctcttccttctcccctcctccctgtcttctgtccttcctcaaacccacttgccccctttgtcttccctccttgctgccaatcaaaggctctgttggacagcagttgctgcaggcagtctgccaaggctcttaggaatcagagggcagagcaagtcatcttcatgtatgatcctggtgagggttgagctcagtcaggaaggagccagcctttgtgtcacatggcacagccagtcctcagtgcttccagagggagagctggtcctatgtttggaaggtcccctaggaggacaggatcctgttctggtgaatcttagacaaatgccactcgtaggtgaccttggaaagggagttttgagtcatgggctttcgggatagttgagcattctgtttgaactcgcctaaaacttatgaagagtagtcccttgctgtgtgccttcagcatggaccaactgactgacaagttccgtgtcagtctgcatctgagctgatgctcagtcgagttcatgcaagtttcgttctcctggagcctcgtgggactgccagtaagctatccctagagaagccaggagggaccacagtggccttggcttcaaagtcagtgactctgtgtacatgtaccttcctttatgggaaggatattcacaatgtggccacatggtgctaggacctttcaggtcacctagtcagatttctcaaggccttagtaacccaagacatgccaggttaaatactgtgacacacttaggaactgagaaagctggcagctatgctctgcaaggtgtgtcagtggcatcagccaacagcccaatcagagatgccaccttggctcctggagctctagagcagggttgcaaagccacttcccagcactgatggcaaagtcttagtgccagactccttggagaccgatggggaccaggcagccttggtgtccctctgccctgcctcctgttgtcttcaagaggctgtgtgacctagtgaagacacattcgatgtttaagggagccttaaagatgcacacatgcaaaatttagtcatcgactggactaaggtctatcatggcctcccttttgatcctgtctgcgggggctcctccagcccctccctccacggcacctctttctgctggtcctataggcccttccccagaaaagattgcttgaagcagaccagaaaaacatggcccttgggctcctatacactcagcttgcatctgatcctaaacatgtctcaccttgagcctttatctaacacactatgtcatgggttatgttagacactcagcagccagatgcatggaggatggggacttttgttctgcatcattggtttgaaaatgactggctgaactccagtttaaagttttcccggtgtcccctgagattaaccagcctttgaccccagggcctcctacagccaaaaagcctgccaccatcactgtatctctctttaacctgtgtggcctttcaagaggagtttccactagaaaaatcaggaactccctacagctgctcacccagcatagagagtaggtcctgttctccttctacagccccggggggcggggcgggggggtgagaacaggaatctaaacccatcttcaagtagataccaccagcctgatggccatcttggcttcctgctgagccaccaggcaccactctgtccttggtccacatttatatggctgactcccaagaccagagtaggttaagaatattagagtaagagcctgactcaggccagagatgacccttgtctttatctaaaaacactaaaatctgcatggagaggttttgatttaaataagtggaccacgttcctcaccgagactcctctgtggggggatgtgtgctgacatctctggttttacttcagtggagtgtcctcctggctcatcaggaaaagatgtatggtccctaatcaggacagagtgtgagaggctgctgctgcctggcctgtcaccagcctgggacccctgaggacattttctcaacgtcagacctcagccatcttacttctcagaatcttagtctgagacatgagaaatggaggccgttgcttttctcccaaaggggaactttagttagggggggtgggtggttgaatcgtgaggaacacctttcagagaatcctgtgccaaccagaagtggaccaaactgcgcccagggtcagcgtcacgtcttgaccaagcagctggcagcacctgacaccttagtggcgatcaagtactactgttggcaaaaggcaaggagaagcaccgttttgtgtcatagcaaccaggctgtttcgttgtcttttcatggggtcaaatatgaaaaccttgcagttctatgtagagggagaaataacgctcttctctcacctctttccccaacccaaactccactgcaaactcatttattcggcaaagacaaatgcttcatccctgggtcccaggtcccaggtggtgagggcagagcagaggcaggtggccctctgggctccctggttggcacaaggcactgggacatctttcccaggcccctgggactcagctgtgcttcaagtcacacacagagcctggccctgaagaccagggagtgattgagtctttcctggtaaaattgtcactttgggaaatttcacttaaaaaaaaaaaaaaaaggcggggcccagccagctcttttgtcaagcctgaaactaagtgtacctcacaacagacgaacgccacttggcaccctttctaggaagatgtcagtattatccatgttaagtgtcacgatgttttctgcactgaatgaaaaagaatgctcttcatagctatatcttaatactgtgatttttaaaacaaaaacaaacaaacaaaccactctgatacaactagttaactagcttgtggtcgtgtgtctaatcaccgatacctggagttctctaatccagggttcagtccagtgtatgttcaaagcctagctcttgaacctgctgggcacagcagaagcccaaataaacaactgcagacagctgccccggggtgtgcacccctcacctgtcactgtccctaagctgtgtacaatctcttcccaatgtgtgaatctgttccttcagtcacttttatttaaaaacaaaaaacaagtgccagccaggtttgactgaaccatgacaggaaaccgtcaactttacatcagtgtttccgtcagggccactgtgtaggcctcttaggctactgttttagagaattgttagctatgaattattaccaaagaacggtggcaatttgagctgttctgttgagtctccatgtcatttccaatgtcctggccacatttctccttggcgtgtcttcataactccaagatccacaatgtcattatcacattggaggccaagggggtggggtcttacagacacacctgaggacaggcacatttccaaagcaaggtctgaggcctgcttcctgccacttgctcactactgtccttggtgccatcctctcagacctggggatttgcagcccttcacccctgtgataacaggcctaaataggaattattgagccgataccagcatccccacccccaccccccagcttgttgtggatacagggctatccaggacatcaggaatcagggtgaacacagaagggcaaatagaattttctagtcacatgagctgattggttccaggcaattagaaaatggctgtaacttaatcttaatttaaaaaaaaaaaaatcgagtctgttttctccataggagactgaactgactgtacgagtgatttatatcctgaatttatgggaacccgtatgtttggaacgtcctcctgtaagctgatgaatgtaaagagttaatttcagggtacagttttgccttaatggttttaaaaaaaaataaactatttttaaaaattaaaaaaaaaa

SEQ ID NO: 244 - DNA, 5292 bp, Homo sapiens
ctcttgcagtgaggtgaagacatttgaaaatcaccccactgcaaactcctccccctgctagaaacctcacattgaaatgctgtaaatgacgtgggccccgagtgcaatcgcgggaagccagggtttccagctaggacacagcaggtcgtgatccgggtcgggacactgcctggcagaggctgcgagcatggggccctggggctggaaattgcgctggaccgtcgccttgctcctcgccgcggcggggactgcagtgggcgacagatgcgaaagaaacgagttccagtgccaagacgggaaatgcatctcctacaagtgggtctgcgatggcagcgctgagtgccaggatggctctgatgagtcccaggagacgtgcttgtctgtcacctgcaaatccggggacttcagctgtgggggccgtgtcaaccgctgcattcctcagttctggaggtgcgatggccaagtggactgcgacaacggctcagacgagcaaggctgtccccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcgctgtggccacctgtcgccctgacgaattccagtgctctgatggaaactgcatccatggcagccggcagtgtgaccgggaatatgactgcaaggacatgagcgatgaagttggctgcgttaatgtgacactctgcgagggacccaacaagttcaagtgtcacagcggcgaatgcatcaccctggacaaagtctgcaacatggctagagactgccgggactggtcagatgaacccatcaaagagtgcgggaccaacgaatgcttggacaacaacggcggctgttcccacgtctgcaatgaccttaagatcggctacgagtgcctgtgccccgacggcttccagctggtggcccagcgaagatgcgaagatatcgatgagtgtcaggatcccgacacctgcagccagctctgcgtgaacctggagggtggctacaagtgccagtgtgaggaaggcttccagctggacccccacacgaaggcctgcaaggctgtgggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatggcttcatgtactggactgactggggaactcccgccaagatcaagaaagggggcctgaatggtgtggacatctactcgctggtgactgaaaacattcagtggcccaatggcatcaccctagatctcctcagtggccgcctctactgggttgactccaaacttcactccatctcaagcatcgatgtcaacgggggcaaccggaagaccatcttggaggatgaaaagaggctggcccaccccttctccttggccgtctttgaggacaaagtattttggacagatatcatcaacgaagccattttcagtgccaaccgcctcacaggttccgatgtcaacttgttggctgaaaacctactgtccccagaggatatggttctcttccacaacctcacccagccaagaggagtgaactggtgtgagaggaccaccctgagcaatggcggctgccagtatctgtgcctccctgccccgcagatcaacccccactcgcccaagtttacctgcgcctgcccggacggcatgctgctggccagggacatgaggagctgcctcacagaggctgaggctgcagtggccacccaggagacatccaccgtcaggctaaaggtcagctccacagccgtaaggacacagcacacaaccacccgacctgttcccgacacctcccggctgcctggggccacccctgggctcaccacggtggagatagtgacaatgtctcaccaagctctgggcgacgttgctggcagaggaaatgagaagaagcccagtagcgtgagggctctgtccattgtcctccccatcgtgctcctcgtcttcctttgcctgggggtcttccttctatggaagaactggcggcttaagaacatcaacagcatcaactttgacaaccccgtctatcagaagaccacagaggatgaggtccacatttgccacaaccaggacggctacagctacccctcgagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctcttaaaaaatgaatttggccagacacaggtgcctcacgcctgtaatcccagcactttgggaggctgagctggatcacttgagttcaggagttggagaccaggcctgagcaacaaagcgagatcccatctctacaaaaaccaaaaagttaaaaatcagctgggtacggtggcacgtgcctgtgatcccagctacttgggaggctgaggcaggaggatcgcctgagcccaggaggtggaggttgcagtgagccatgatcgagccactgcactccagcctgggcaacagatgaagaccctatttcagaaatacaactataaaaaaataaataaatcctccagtctggatcgtttgacgggacttcaggttctttctgaaatcgccgtgttactgttgcactgatgtccggagagacagtgacagcctccgtcagactcccgcgtgaagatgtcacaagggattggcaattgtccccagggacaaaacactgtgtcccccccagtgcagggaaccgtgataagcctttctggtttcggagcacgtaaatgcgtccctgtacagatagtggggattttttgttatgtttgcactttgtatattggttgaaactgttatcacttatatatatatatatacacacatatatataaaatctatttatttttgcaaaccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaattaaatttcttaaatgaaccaatttgtctaaaaaaaaaaa

SEQ ID NO: 245 - DNA, 4549 bp, Mus musculus
gcagactcctcccccgcctggaaacctcgcccctagtactgggaatgactctgggcgtgcggcgtagtttgcagccgggacaccgtgaggcttgcgagcccagattcgcagccgagacaccgtggggcccgcgatccagtgtttgcagcgggaacatttcggggtctgtgatccgagtgaggacgcaacgcagaagctaaggatgagcaccgcggatctgatgcgtcgctgggtcatcgccctgctcctggctgctgccggagttgcagcagaagactcatgcagcaggaacgagttccagtgtagagacggaaaatgcatcgctagcaagtgggtgtgcgatggcagccccgagtgcccggatggctccgatgagtccccagagacatgcatgtctgtcacctgtcagtccaatcaattcagctgtggaggccgtgtcagccgatgcattcctgactcctggagatgtgatggacaggtagactgtgaaaatgactcagacgaacaaggctgtccccccaagacgtgctcccaggatgacttccgatgccaggatggcaagtgcatctccccgcagtttgtgtgtgatggagaccgagattgcctagatggctctgatgaggcccactgccaggccaccacttgtggccccgcccacttccgctgcaactcatccatatgcatccccagtctttgggcctgcgacggggatgtcgactgtgttgacggctccgatgagtggccacagaactgccagggccgagacacggcctccaaaggcgttagcagcccctgctcctccctggagttccactgtggtagcagtgagtgtatccatcgcagctgggtctgtgacggcgaggcagactgcaaggacaagtcagatgaggagcactgcgcggtggccacctgccgacctgatgaattccagtgtgcagatggctcctgcattcacggtagccgccagtgtgaccgtgaacatgactgcaaggacatgagcgacgagctcggctgcgtcaatgtgacacagtgtgatggccccaacaagttcaagtgtcacagtggggagtgcatcagcttggacaaggtgtgcgactccgcccgcgactgccaggactggtcggatgagcccatcaaggagtgcaagaccaacgagtgtttggacaacaatggtggctgttcccacatctgcaaggacctcaagattggctctgagtgcctgtgtcccagcggcttccggttggtggacctccacaggtgtgaagatattgacgagtgtcaggagccagacacctgcagccagctctgtgtgaacctggaaggcagctacaagtgtgagtgccaggccggcttccacatggacccacacaccagggtctgcaaggctgtgggctccataggctatctgctcttcaccaaccgccacgaggtccggaagatgaccctggaccgcagcgagtacaccagtctgctccccaacctgaagaatgtggtggctctcgacacggaggtgaccaacaatagaatctactggtccgacctgtcccaaaaaaagatctacagcgccctgatggaccaggcccctaacttgtcctacgacaccatcatcagtgaggacctgcatgcccctgacgggctggcggtagactggatccaccgcaacatctactggacagattcagtcccaggcagcgtatctgtggctgacaccaagggcgtaaagaggaggacactgttccaagaggcagggtccagacccagagccatcgtagtggaccctgtgcatggcttcatgtactggacagattggggaacacccgccaagatcaagaaagggggtttgaatggtgtggacatccactcactggtgaccgaaaacatccagtggccaaatggcatcacactagatctttccagtggccgtctctattgggttgattccaaactccactctatctccagcatcgatgtcaatgggggcaatcggaaaaccattttggaggatgagaaccggctggcccaccccttctccttggccatctatgaggacaaagtgtattggacagatgtcataaacgaagccattttcagtgccaatcgactcacgggttcagatgtgaatttggtggctgaaaacctcttgtccccggaggacattgtcctgttccacaaggtcacacagcctagaggggtgaactggtgtgagacaacagccctcctccccaatggtggttgccagtacctgtgcctgcccgccccacagatcggtccccactcgcccaaattcacctgcgcctgccctgatggcatgctgctggccaaggacatgcggagctgcctcacagaagtcgacactgtactgaccacccaggggacatccgccgtccggcctgtggtcaccgcatcagctaccaggccaccgaagcacagtgaggatctctcagctcccagtactcctaggcagcctgtggacaccccagggctcagcacagtggcgtcagtgacagtgtcccaccaagtccagggtgacatggctggcagagggaatgaggagcagccacatggtatgaggttcctgtccatcttcttccctattgcactggttgccctccttgtccttggggccgtcctgctgtggaggaactggcggctgaagaacatcaacagcataaactttgacaacccagtctaccagaagaccacagaggacgagctccacatttgccgaagccaggatggctatacctacccctcaagacagatggtcagcctggaggacgatgtggcatgagcagccgggagagccgtctctttccgggatccattgccaagcttaggcagaaaagacactctctccagacctccccatccagcactggtcctgccacctccctgggctctgtgttgctcaaagcaagataagagcaaagctgggctgggggccaagctcagctgcctgtctgccccaggttctgttttatatatttattgtctggggacagaaaaggctactggctgtgcttgaaattcgaattctgcctgggaatttttttttttctcccatcttcatttccttggaagccaaataggctgtcccagaagcttctgaattctactcttttcaacactaacacggaggaggaagagacccacccaggcagagagaagcctgctggacatgagacagcaggtactactgaccgggtcctgggtaccatagccagtccctaacctcaggacttcctgcattgaccttcatcccagagccttcctgcctgactctgccgcccccatcagaagccaggaaagtgactcgtgacattcggtactgatcttgctggatcttgaggccggcagctgccagtgatggatacccgctcatgcctttgccaaaacgtcacccgttcctggagggacaagcccaagtcgccattctcccttaatatttatcaagtgcctgagacaactggttgccttgctcaggagtcctggcctgctcagtgtcctgctgctcaggggtggccggcaggacccctgtcctgtgcccagcccccgagtctccgagtgaggcttgcacttctctctgcgcacttttcccgttctgtgctgggcacccacgtggtccacatttgtactcctaggttgcactgaccctggtgcattggatgggacctcaggccggaagtggccccgaatcattgaccacagaagataattgccaggctccaagcatccattgccttcttcagtactggggggaactcagggcctctgtctggtgtttagttagtctgtttgtttgtttgtttgtttgtttgtttggtggtttctggctctgcacagcagagttgtttagctcctctggtaacgtcatcctctctcacagagacatccagcctgctgaaggggagagatggggcgaggggagggatacacgcatggtttctcaggtgtggtggcacttggctttaatcctatgctcaagaggaagaggtgggcacatgtctgaggtccaagcctacatagtgagaccttatatatctaaaaaccaaaagaaatcccagactatttggtgggacttggaagaatacttagaaattgccacagatttgtcacatgggtaacctaagaagacagtggtggccttacttggattcctgggtagatccacctgtccactactcaagacacaagggcacactgcccagcccactgggacacttgtaaagagctctgtaatgtgccgatggcacctggctcggttttcattctgtatattcaaggatatcacacatatgtattaaatctatttatttttgcaaaccctgattgctgcacctctctgcaatttctccaggttaggctggggtgatactctgggatgctctgtatacaaagatgatttgaatgggctgatctcaggcctgtcctgtgcgttgctttgagtgggtgggaactgctttgaaacccttgttcagatgtttttataggctgaaaatatcatactgtgatggattaaattcttttttggaaaaaaaaaaaaaaaaaa

SEQ ID NO: 246 - DNA, 3288 bp, Homo sapiens
ccccgcgctgcgcggagcagggaccaggcggttgcggcggcgacagccatggccggcgcgctggcaggtctggccgcgggcttgcaggtcccgcgggtcgcgcccagcccagactcggactcggacacagactcggaggacccgagtctccggcgcagcgcgggcggcttgctccgctcgcaggtcatccacagcggtcacttcatggtgtcgtcgccgcacagcgactcgctgccccggcggcgcgaccaggaggggtccgtggggccctccgacttcgggccgcgcagtatcgaccccacactcacacgcctcttcgagtgcttgagcctggcctacagtggcaagctggtgtctcccaagtggaagaatttcaaaggcctcaagctgctctgcagagacaagatccgcctgaacaacgccatctggagggcctggtatatccagtatgtgaagcggaggaagagccccgtgtgtggcttcgtgacccccctgcaggggcctgaggctgatgcgcaccggaagccggaggccgtggtcctggaggggaactactggaagcggcgcatcgaggtggtgatgcgggaataccacaagtggcgcatctactacaagaagcggctccgtaagcccagcagggaagatgacctcctggcccctaagcaggcggaaggcaggtggccgccgccggagcaatggtgcaaacagctcttctccagtgtggtccccgtgctgctgggggacccagaggaggagccgggtgggcggcagctcctggacctcaattgctttttgtccgacatctcagacactctcttcaccatgactcagtccggcccttcgcccctgcagctgccgcctgaggatgcctacgtcggcaatgctgacatgatccagccggacctgacgccactgcagccaagcctggatgacttcatggacatctcagatttctttaccaactcccgcctcccacagccgcccatgccttcaaacttcccagagccccccagcttcagccccgtggttgactccctcttcagcagtgggaccctgggcccagaggtgcccccggcttcctcggccatgacccacctctctggacacagccgtctgcaggctcggaacagctgccctggccccttggactccagcgccttcctgagttctgatttcctccttcctgaagaccccaagccccggctcccaccccctcctgtacccccacctctgctgcattaccctccccctgccaaggtgccaggcctggagccctgccccccacctcccttccctcccatggcaccacccactgctttgctgcaggaagagcctctcttctctcccaggtttcccttccccaccgtccctcctgccccaggagtgtctccgctgcctgctcctgcagccttcccacccaccccacagtctgtccccagcccagcccccacccccttccccatagagcttctacccttggggtattcggagcctgcctttgggccttgcttctccatgcccagaggcaagccccccgccccatcccctaggggacagaaagccagcccccctaccttagcccctgccactgccagtccccccaccactgcggggagcaacaacccctgcctcacacagctgctcacagcagctaagccggagcaagccctggagccaccacttgtatccagcaccctcctccggtccccagggtccccgcaggagacagtccctgaattcccctgcacattccttcccccgaccccggcccctacaccgccccggccacctccaggcccggccacattggccccttccaggcccctgcttgtccccaaagcggagcggctctcacccccagcgcccagcggcagtgaacggcggctgtcaggggacctcagctccatgccaggccctgggactctgagcgtccgtgtctctcccccgcaacccatcctcagccggggccgtccagacagcaacaagaccgagaaccggcgtatcacacacatctccgcggagcagaagcggcgcttcaacatcaagctggggtttgacacccttcatgggctcgtgagcacactcagtgcccagcccagcctcaaggtgagcaaagctaccacgctgcagaagacagctgagtacatccttatgctacagcaggagcgtgcgggcttgcaggaggaggcccagcagctgcgggatgagattgaggagctcaatgccgccattaacctgtgccagcagcagctgcccgccacaggggtacccatcacacaccagcgttttgaccagatgcgagacatgtttgatgactacgtccgaacccgtacgctgcacaactggaagttctgggtgttcagcatcctcatccggcctctgtttgagtccttcaacgggatggtgtccacggcaagtgtgcacaccctccgccagacctcactggcctggctggaccagtactgctctctgcccgctctccggccaactgtcctgaactccctacgccagctgggcacatctaccagtatcctgaccgacccgggccgcatccctgagcaagccacacgggcagtcacagagggcacccttggcaaacctttatagtcctggccagaccctgctgctcactcagctgccctgggggctgctttccctgggcacgggctccagggatcatctctgggcactcccttcctgccccaggccctggctctgcccttccctggggggtggagcagggtccaggtttcacacttgccacctcctggaggtcaagaagagcagagtccccgtccctgctctgccactgtgctccagcaccgtgaccttgggtgactcgtccgctgtctttggaccgctgtgtttcaatctgcaaaatggggatggggaaggttcaatcagcagatgacccccaggccttggcagctgtgacattgggggcctaggctggcaactccgggggctcaacggtggaaagaggaggatgctgtttctctgtcacctccacttgctccccgacaggtggggcacagacctctgttcctgagcagagaagcagaaaaggaggttccctctctctgctccttcactgctgacccagaggggctgcaggatggtttcccctgggagaggccaggagggcctgatcccaggagacaccagggccagagtgaccacagcagggcaggcatcatgtgtgtgtgtgtgtgtggatgtgtgtgtgtgggttttgtaaagaattcttgaccaataaaagcaaaaactgtctgctggttaaaaaaaaaa

SEQ ID NO: 247 - DNA, 3649 bp, Mus musculus
agagcgcccgagagttggcgacaatagtggccatggcgcgcgcgctggcggatctatccgtgaacttgcaggtcccccgggtcgtccctagcccggactcggactcggatacggacttggaggatccgagtccccggcgcagcgcgggtggcctgcatcgatcacaggtcatccacagcggacacttcatggtgtcttcgccgcacagcgactcgctgacccggcgacgcgaccaggaggggcccgtggggctcgccgacttcgggccgcgcagcatcgatccgacactcacccacctcttcgagtgcttgagcctggcttacagtggcaagctggtctctcccaagtggaagaacttcaaaggcctcaagttgctatgccgggacaagatccggctgaacaacgccatctggagagcctggtacattcagtatgtgcaacggaggaagagcccagtgtgtggtttcgtgacccctctgcaggggtctgaagcagatgagcaccggaaacctgaggctgtcatcctggagggtaattactggaagcggcgcatcgaggtggtgatgcgcgaataccacaagtggagaatctactacaaaaagcggctccgtaagtccagcagggaaggggatttcctggctcccaagcaggtggaaggtgggtggccgccaccagagcgatggtgcgaacagctcttctccagcgtggtgcctgtgctgcttgggggctccgaggaggagcctgggggccggcagcttctagacctggactgcttcttgtccgatatctccgacacactcttcaccatgacacagcccagtccttcgtccctgcagctgcccccagaagatgcttatgttggcaatgctgacatgatccagccagacctgacgccgctgcagcccagcctagatgacttcatggagatatcagatttcttcaccaattaccgcccccctcagacacccacatcttcaaactacatagagtcccccagctttggccccatggctgactccctcttcagcagtgggatcctggccccagagatgccatctccagcctcgtcttcctcctcctcagggatgacccctcactcagggaatacacgcctacaggctcggaacagctgctctggacccttggatcccaacccctttctgagctctgaattccttcttcctgaagaccctaagaccaagatcccacctgctcctggaccgacccctctccttccattccccacccctgtcaaggtgcatggcttagagccctgcaccccctctcccttccccacaatggctccgcccccctctttgttgccagaagaatctctcctctctgccaggttcccattcacctcagcccctcctgctccaggagtgtctacgcttcctgcacccacaacctttgtccccaccccacagcccggccctggtcccgtccccttctctgtagaccatctgccccatgggtacctggaacccgtctttgggcctcacttcactgtgcctcagggtatgcaacccaggtgcaagccctcctccccatcccctgggggacaaaaagcaagtccacccaccttggcctctgccaccgccagtcccactgccactgccactgccagagacaacaacccctgtcttacacagctgctcagggcagccaagcctgagcaagcactggagcctccgactatgcccggtaccctcctccggcctccagagtccccgcaggatacagtttctgaaatcccccgtgcccgtgcctttttccccccaatcccggcccctacaccaccccggccacctccaggcccagccacattggctcctcccaggtccctggttgtccccaaagcagagcggctctcgcctccagcctccagcggcagtgagcggcgactatcaggggatctcaactccatacaaccctcgggggcactgagtgtccacctgtctccccctcaaactgtcctaagccggggtcgtgtagacaacaacaagatggagaaccgacgtatcacacacatctccgcggagcagaagaggcggttcaatattaagctaggattcgacaccctgcacggacttgtcagcacgctcagtgcccagcccagcctcaaggtgagcaaagcaaccacgcttcagaagacagcggagtacatcctgatgctgcagcaggaacgggcagctatgcaggaggaggcgcagcagctgcgggatgaaatagaggagctcaacgctgccatcaacttgtgccagcagcagctaccggccaccggggtgcccatcacacatcagcgctttgaccagatgcgggacatgtttgatgactatgtccggacgcgcacgctgcacaactggaagttctgggtgttcagcatcctcatccgacctttatttgaatccttcaatgggatggtgtctaccgccagcttgcacagcctccgccagacctcactggcctggctggaacagtactgttccctacctgctctccggccaactgtcctgaattcccttcgccaactcagcacttccacaagcatcctgactgaccccagccttgtgcctgagcaagccacacgggcagtcacagagggcaccctggggagaccattataatcctggtgaaagtttccaagctccaggaacaacttgtgaacacgcttctaaaaatcctggctggccgtttccctgcagatctggaaggttccaagtgttgcactcaccacctccttggggatggagaaaaacctagttccattcctgcactgttgctaatgctatgatccctggtgactcatatcccatctttggacctccctttaataacagagggccccaaatgcattagcagctgcagcactggggacctaaacaggagctctgatgagagatgtcggtctgtttcctcacaacttcctgctttggataaagggtaccatccttagttcctgagcagagaggcagagcaggagatctcctctctttgcctttgcactagtgacatggggagctatagggtggcttcctgactgaggccactggggtctgatgccagaagagatcagggcaagggctagccagagcatggcaggcatcttgcatgaatgtagatgtgtgtgtgcgtatgtggattttataaaaaagaaaatgttcttcatcaataaaagcaaaaactgtctgcaagggttggtgttggtgtgactggcaatgtgtctcagtatgggactcagagctgccagcagtgaaaggtgacatagaagaccgatcctgtgggttataaacaacctttgagtacttttgatttgttatttttgtttttgttttttcgagacagggttttttttgtgtagccctggctgtcctggaacttactggataggccaggctggcctccaactcagagatccacccacccctgcctctggaatactggaattaaaggcatatgtcaccaccacccggccctttgagtacttttcaacttgcttgtgtgcagttgtgctcacctgtgcttgtgtgtggaggccgtcggctgacctgggtacctccttcgtgctctctgccttaattttaaaatgcttccgaatatattctagaactgggcatggtgatgcacacctttaatcccagtacttggg

SEQ ID NO: 248 - RNA, 281 nt, Homo sapiens
uuguuugaaugaggcuucaguacuuuacagaaucguugccugcacaucuuggaaacacuugcugggauuacuucuucagguuaacccaacagaaggcucgagaagguauauugcuguugacagugagcgcggcggucauugucacuggucauagugaagccacagauguaugaccagugacaaugaccgccuugccuacugccucggaauucaaggggcuacuuuaggagcaauuaucuuguuuacuaaaacugaauaccuugcuaucucuuugauacauu

SEQ ID NO: 249 - RNA, 21 nt, Homo sapiens
  modified_base (21)..(21): 2'-OMe modified nucleotide
cggucauugucacuggucauu

SEQ ID NO: 250 - RNA, 21 nt, Homo sapiens
  modified_base (21)..(21): 2'-OMe modified nucleotide
ugaccagugacaaugaccguu

SEQ ID NO: 251 - protein, 358 aa, Homo sapiens
MESADFYEAEPRPPMSSHLQSPPHAPSSAAFGFPRGAGPAQPPAPPAAPEPLGGICEHETSIDISAYIDPAAFNDEFLADLFQHSRQQEKAKAAVGPTGGGGGGDFDYPGAPAGPGGAVMPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 252 - protein, 239 aa, Homo sapiens
MPGGAHGPPPGYGCAAAGYLDGRLEPLYERVGAPALRPLVIKQEPREEDEAKQLALAGLFPYQPPPPPPPSHPHPHPPPAHLAAPHLQFQIAHCGQTTMHLQPGHPTPPPTPVPSPHPAPALGAAGLPGPGSALKGLGAAHPDLRASGGSGAGKAKKSVDKNSNEYRVRRERNNIAVRKSRDKAKQRNVETQQKVLELTSDNDRLRKRVEQLSRELDTLRGIFRQLPESSLVKAMGNCA

SEQ ID NO: 253 - DNA, 19 bp, Artificial Sequence
  source: /note="Description of Artificial Sequence: Synthetic oligonucleotide"
ctgagtaatcgcttaaaga

SEQ ID NO: 254 - DNA, 19 bp, Artificial Sequence
  source: /note="Description of Artificial Sequence: Synthetic oligonucleotide"
gaaactttagcgagtcaga

SEQ ID NO: 255 - RNA, 21 nt, Artificial Sequence
  source: /note="Description of Artificial Sequence: Synthetic oligonucleotide"
ucuacugucacucaguaguuu

SEQ ID NO: 256 - RNA, 21 nt, Artificial Sequence
  source: /note="Description of Artificial Sequence: Synthetic oligonucleotide"
cggucauugucacuggucauu

SEQ ID NO: 257 - RNA, 21 nt, Artificial Sequence
  source: /note="Description of Artificial Sequence: Synthetic oligonucleotide"
ugaccagugacaaugaccguu

SEQ ID NO: 258 - RNA, 21 nt, Artificial Sequence
  source: /note="Description of Artificial Sequence: Synthetic oligonucleotide"
  modified_base (1)..(1): Inverted abasic modification
cggucauugucacuggucauu

SEQ ID NO: 259 - RNA, 21 nt, Artificial Sequence
  source: /note="Description of Artificial Sequence: Synthetic oligonucleotide"
  modified_base (1)..(1): Inverted abasic modification
ugaccagugacaaugaccguu

SEQ ID NO: 260 - RNA, 21 nt, Artificial Sequence
  source: /note="Description of Artificial Sequence: Synthetic oligonucleotide"
cggucauucagacuggucauu

SEQ ID NO: 261 - RNA, 21 nt, Artificial Sequence
  source: /note="Description of Artificial Sequence: Synthetic oligonucleotide"
ugaccagucugaaugaccguu

SEQ ID NO: 262 - RNA, 21 nt, Artificial Sequence
  source: /note="Description of Artificial Sequence: Synthetic oligonucleotide"
  modified_base (21)..(21): 2'-OMe modified nucleotide
acuacugagugacaguagauu

SEQ ID NO: 263 - RNA, 21 nt, Artificial Sequence
  source: /note="Description of Artificial Sequence: Synthetic oligonucleotide"
  modified_base (2)..(2): 2'-OMe modified nucleotide
  modified_base (4)..(4): 2'-OMe modified nucleotide
  modified_base (6)..(6): 2'-OMe modified nucleotide
  modified_base (8)..(8): 2'-OMe modified nucleotide
  modified_base (10)..(10): 2'-OMe modified nucleotide
  modified_base (12)..(12): 2'-OMe modified nucleotide
  modified_base (14)..(14): 2'-OMe modified nucleotide
  modified_base (16)..(16): 2'-OMe modified nucleotide
  modified_base (19)..(21): 2'-OMe modified nucleotide
cggucauugucacuggucauu

SEQ ID NO: 264 - RNA, 21 nt, Artificial Sequence
  source: /note="Description of Artificial Sequence: Synthetic oligonucleotide"
  modified_base (2)..(2): 2'-OMe modified nucleotide
  modified_base (7)..(7): 2'-OMe modified nucleotide
  modified_base (9)..(9): 2'-OMe modified nucleotide
  modified_base (14)..(14): 2'-OMe modified nucleotide
  modified_base (16)..(16): 2'-OMe modified nucleotide
  modified_base (20)..(21): 2'-OMe modified nucleotide
cggucauugucacuggucauu

SEQ ID NO: 265 - RNA, 21 nt, Artificial Sequence
  source: /note="Description of Artificial Sequence: Synthetic oligonucleotide"
  modified_base (1)..(1): 2'-OMe modified nucleotide
  modified_base (4)..(5): 2'-OMe modified nucleotide
  modified_base (7)..(8): 2'-OMe modified nucleotide
  modified_base (10)..(11): 2'-OMe modified nucleotide
  modified_base (13)..(14): 2'-OMe modified nucleotide
  modified_base (17)..(18): 2'-OMe modified nucleotide
  modified_base (20)..(21): 2'-OMe modified nucleotide
cggucauugucacuggucauu

SEQ ID NO: 266 - RNA, 21 nt, Artificial Sequence
  source: /note="Description of Artificial Sequence: Synthetic oligonucleotide"
  modified_base (4)..(4): 2'-OMe modified nucleotide
  modified_base (7)..(8): 2'-OMe modified nucleotide
  modified_base (10)..(10): 2'-OMe modified nucleotide
  modified_base (14)..(14): 2'-OMe modified nucleotide
  modified_base (17)..(17): 2'-OMe modified nucleotide
  modified_base (20)..(21): 2'-OMe modified nucleotide
cggucauugucacuggucauu

SEQ ID NO: 267 - RNA, 21 nt, Artificial Sequence
  source: /note="Description of Artificial Sequence: Synthetic oligonucleotide"
  modified_base (6)..(6): 2'-OMe modified nucleotide
  modified_base (15)..(15): 2'-OMe modified nucleotide
  modified_base (20)..(21): 2'-OMe modified nucleotide
cggucauugucacuggucauu

SEQ ID NO: 268 - RNA, 21 nt, Artificial Sequence
  source: /note="Description of Artificial Sequence: Synthetic oligonucleotide"
  modified_base (4)..(4): 2'-OMe modified nucleotide
  modified_base (6)..(6): 2'-OMe modified nucleotide
  modified_base (14)..(15): 2'-OMe modified nucleotide
  modified_base (20)..(21): 2'-OMe modified nucleotide
cggucauugucacuggucauu

SEQ ID NO: 269 - RNA, 21 nt, Artificial Sequence
  source: /note="Description of Artificial Sequence: Synthetic oligonucleotide"
  modified_base (20)..(21): 2'-OMe modified nucleotide
cggucauugucacuggucuuu

SEQ ID NO: 270 - RNA, 21 nt, Artificial Sequence
  source: /note="Description of Artificial Sequence: Synthetic oligonucleotide"
  modified_base (4)..(4): 2'-OMe modified nucleotide
  modified_base (7)..(8): 2'-OMe modified nucleotide
  modified_base (10)..(10): 2'-OMe modified nucleotide
  modified_base (14)..(14): 2'-OMe modified nucleotide
  modified_base (17)..(17): 2'-OMe modified nucleotide
  modified_base (20)..(21): 2'-OMe modified nucleotide
cggucauugucacuggucuuu

SEQ ID NO: 271 - RNA, 21 nt, Artificial Sequence
  source: /note="Description of Artificial Sequence: Synthetic oligonucleotide"
  modified_base (21)..(21): 2'-OMe modified nucleotide
ucuacugucacucaguaguuu

SEQ ID NO: 272 - RNA, 21 nt, Artificial Sequence
  source: /note="Description of Artificial Sequence: Synthetic oligonucleotide"
  modified_base (21)..(21): 2'-OMe modified nucleotide
ugaccagugacaaugaccguu

SEQ ID NO: 273 - RNA, 21 nt, Artificial Sequence
  source: /note="Description of Artificial Sequence: Synthetic oligonucleotide"
  modified_base (20)..(21): 2'-OMe modified nucleotide
ugaccagugacaaugaccguu

SEQ ID NO: 274 - RNA, 21 nt, Artificial Sequence
  source: /note="Description of Artificial Sequence: Synthetic oligonucleotide"
  modified_base (1)..(1): 2'-OMe modified nucleotide
  modified_base (3)..(3): 2'-OMe modified nucleotide
  modified_base (6)..(6): 2'-OMe modified nucleotide
  modified_base (8)..(8): 2'-OMe modified nucleotide
  modified_base (10)..(10): 2'-OMe modified nucleotide
  modified_base (12)..(12): 2'-OMe modified nucleotide
  modified_base (14)..(14): 2'-OMe modified nucleotide
  modified_base (16)..(16): 2'-OMe modified nucleotide
  modified_base (19)..(21): 2'-OMe modified nucleotide
ugaccagugacaaugaccguu

SEQ ID NO: 275 - RNA, 21 nt, Artificial Sequence
  source: /note="Description of Artificial Sequence: Synthetic oligonucleotide"
  modified_base (2)..(2): 2'-OMe modified nucleotide
  modified_base (6)..(6): 2'-OMe modified nucleotide
  modified_base (9)..(9): 2'-OMe modified nucleotide
  modified_base (14)..(14): 2'-OMe modified nucleotide
  modified_base (19)..(21): 2'-OMe modified nucleotide
ugaccagugacaaugaccguu

SEQ ID NO: 276 - RNA, 21 nt, Artificial Sequence
  source: /note="Description of Artificial Sequence: Synthetic oligonucleotide"
  modified_base (1)..(1): 2'-OMe modified nucleotide
  modified_base (8)..(8): 2'-OMe modified nucleotide
  modified_base (14)..(14): 2'-OMe modified nucleotide
  modified_base (20)..(21): 2'-OMe modified nucleotide
ugaccagugacaaugaccguu

SEQ ID NO: 277 - RNA, 21 nt, Artificial Sequence
  source: /note="Description of Artificial Sequence: Synthetic oligonucleotide"
  modified_base (6)..(6): 2'-OMe modified nucleotide
  modified_base (15)..(15): 2'-OMe modified nucleotide
  modified_base (20)..(21): 2'-OMe modified nucleotide
ugaccagugacaaugaccguu

SEQ ID NO: 278 - RNA, 21 nt, Artificial Sequence
  source: /note="Description of Artificial Sequence: Synthetic oligonucleotide"
gucacuggucagcuccagcuu

SEQ ID NO: 279 - RNA, 21 nt, Artificial Sequence
  source: /note="Description of Artificial Sequence: Synthetic oligonucleotide"
cauugucacuggucagcucuu

SEQ ID NO: 280 - RNA, 21 nt, Artificial Sequence
  source: /note="Description of Artificial Sequence: Synthetic oligonucleotide"
gcggucauugucacuggucuu

SEQ ID NO: 281 - RNA, 21 nt, Artificial Sequence
  source: /note="Description of Artificial Sequence: Synthetic oligonucleotide"
ggcggucauugucacugguuu

SEQ ID NO: 282 - RNA, 21 nt, Artificial Sequence
  source: /note="Description of Artificial Sequence: Synthetic oligonucleotide"
aggcggucauugucacugguu

SEQ ID NO: 283 - RNA, 21 nt, Artificial Sequence
  source: /note="Description of Artificial Sequence: Synthetic oligonucleotide"
caggcggucauugucacuguu

SEQ ID NO: 284 - RNA, 21 nt, Artificial Sequence
  source: /note="Description of Artificial Sequence: Synthetic oligonucleotide"
gcaggcggucauugucacuuu

SEQ ID NO: 285 - RNA, 21 nt, Artificial Sequence
  source: /note="Description of Artificial Sequence: Synthetic oligonucleotide"
cgcaggcggucauugucacuu

SEQ ID NO: 286 - RNA, 21 nt, Artificial Sequence
  source: /note="Description of Artificial Sequence: Synthetic oligonucleotide"
gcgcaggcggucauugucauu

SEQ ID NO: 287 - RNA, 21 nt, Artificial Sequence
  source: /note="Description of Artificial Sequence: Synthetic oligonucleotide"
ugcgcaggcggucauugucuu

SEQ ID NO: 288 - RNA, 21 nt, Artificial Sequence
  source: /note="Description of Artificial Sequence: Synthetic oligonucleotide"
uugcgcaggcggucauuguuu

SEQ ID NO: 289 - RNA, 21 nt, Artificial Sequence
  source: /note="Description of Artificial Sequence: Synthetic oligonucleotide"
auucauccuccucgcgggguu

SEQ ID NO: 290 - RNA, 21 nt, Artificial Sequence
  source: /note="Description of Artificial Sequence: Synthetic oligonucleotide"
gauucauccuccucgcggguu

SEQ ID NO: 291 - RNA, 21 nt, Artificial Sequence
  source: /note="Description of Artificial Sequence: Synthetic oligonucleotide"
ggauucauccuccucgcgguu

SEQ ID NO: 292 - RNA, 21 nt, Artificial Sequence
  source: /note="Description of Artificial Sequence: Synthetic oligonucleotide"
aggauucauccuccucgcguu

SEQ ID NO: 293 - RNA, 21 nt, Artificial Sequence
  source: /note="Description of Artificial Sequence: Synthetic oligonucleotide"
aaggauucauccuccucgcuu

SEQ ID NO: 294 - RNA, 21 nt, Artificial Sequence
  source: /note="Description of Artificial Sequence: Synthetic oligonucleotide"
aaaggauucauccuccucguu

SEQ ID NO: 295 - RNA, 21 nt, Artificial Sequence
  source: /note="Description of Artificial Sequence: Synthetic oligonucleotide"
ugaaaggauucauccuccuuu

SEQ ID NO: 296 - RNA, 21 nt, Artificial Sequence
  source: /note="Description of Artificial Sequence: Synthetic oligonucleotide"
cugaaaggauucauccuccuu

SEQ ID NO: 297 - RNA, 21 nt, Artificial Sequence
  source: /note="Description of Artificial Sequence: Synthetic oligonucleotide"
gcugaaaggauucauccucuu

SEQ ID NO: 298 - RNA, 21 nt, Artificial Sequence
  source: /note="Description of Artificial Sequence: Synthetic oligonucleotide"
agcugaaaggauucauccuuu

SEQ ID NO: 299 - RNA, 21 nt, Artificial Sequence
  source: /note="Description of Artificial Sequence: Synthetic oligonucleotide"
cagcugaaaggauucauccuu

SEQ ID NO: 300 - RNA, 21 nt, Artificial Sequence
  source: /note="Description of Artificial Sequence: Synthetic oligonucleotide"
ccagcugaaaggauucaucuu

SEQ ID NO: 301 - RNA, 21 nt, Artificial Sequence
  source: /note="Description of Artificial Sequence: Synthetic oligonucleotide"
gccagcugaaaggauucauuu

SEQ ID NO: 302 - RNA, 21 nt, Artificial Sequence
  source: /note="Description of Artificial Sequence: Synthetic oligonucleotide"
cgccagcugaaaggauucauu

SEQ ID NO: 303 - RNA, 21 nt, Artificial Sequence
  source: /note="Description of Artificial Sequence: Synthetic oligonucleotide"
gcgccagcugaaaggauucuu

SEQ ID NO: 304 - RNA, 21 nt, Artificial Sequence
  source: /note="Description of Artificial Sequence: Synthetic oligonucleotide"
agcgccagcugaaaggauuuu

SEQ ID NO: 305 - RNA, 21 nt, Artificial Sequence
  source: /note="Description of Artificial Sequence: Synthetic oligonucleotide"
cagcgccagcugaaaggauuu

SEQ ID NO: 306 - RNA, 21 nt, Artificial Sequence
  source: /note="Description of Artificial Sequence: Synthetic oligonucleotide"
ccagcgccagcugaaaggauu

SEQ ID NO: 307 - RNA, 21 nt, Artificial Sequence
  source: /note="Description of Artificial Sequence: Synthetic oligonucleotide"
gccagcgccagcugaaagguu

SEQ ID NO: 308 - RNA, 21 nt, Artificial Sequence
  source: /note="Description of Artificial Sequence: Synthetic oligonucleotide"
ggccagcgccagcugaaaguu

SEQ ID NO: 309 - RNA, 21 nt, Artificial Sequence
  source: /note="Description of Artificial Sequence: Synthetic oligonucleotide"
cuucauccuccucgcgggguu

SEQ ID NO: 310 - RNA, 21 nt, Artificial Sequence
  source: /note="Description of Artificial Sequence: Synthetic oligonucleotide"
ggcuucauccuccucgcgguu

SEQ ID NO: 311 - RNA, 21 nt, Artificial Sequence
  source: /note="Description of Artificial Sequence: Synthetic oligonucleotide"
agcugcuuggcuucauccuuu

SEQ ID NO: 312 - RNA, 21 nt, Artificial Sequence
  source: /note="Description of Artificial Sequence: Synthetic oligonucleotide"
cgccagcugcuuggcuucauu

SEQ ID NO: 313 - RNA, 21 nt, Artificial Sequence
  source: /note="Description of Artificial Sequence: Synthetic oligonucleotide"
agcgccagcugcuuggcuuuu

SEQ ID NO: 314 - RNA, 21 nt, Artificial Sequence
  source: /note="Description of Artificial Sequence: Synthetic oligonucleotide"
  modified_base (2)..(2): 2'-OMe modified nucleotide
  modified_base (7)..(7): 2'-OMe modified nucleotide
  misc_feature (19)..(21): /note="Phosphorothioate linkages"
  modified_base (20)..(21): 2'-OMe modified nucleotide
cuuacgcugaguacuucgauu

SEQ ID NO: 315 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (4)..(4): 2'-OMe modified nucleotide
  modified_base (9)..(9): 2'-OMe modified nucleotide
  modified_base (15)..(16): 2'-OMe modified nucleotide
  modified_base (19)..(19): 2'-OMe modified nucleotide
  misc_feature (20)..(21): /note="Phosphorothioate linkages"
ggaugaaguggagauuagutt

SEQ ID NO: 316 - RNA, 21 nt, Artificial Sequence
  source: /note="Description of Artificial Sequence: Synthetic oligonucleotide"
gcuggagcugaccagugacuu

SEQ ID NO: 317 - RNA, 21 nt, Artificial Sequence
  source: /note="Description of Artificial Sequence: Synthetic oligonucleotide"
gagcugaccagugacaauguu

SEQ ID NO: 318 - RNA, 21 nt, Artificial Sequence
  source: /note="Description of Artificial Sequence: Synthetic oligonucleotide"
gaccagugacaaugaccgcuu

SEQ ID NO: 319 - RNA, 21 nt, Artificial Sequence
  source: /note="Description of Artificial Sequence: Synthetic oligonucleotide"
accagugacaaugaccgccuu

SEQ ID NO: 320 - RNA, 21 nt, Artificial Sequence
  source: /note="Description of Artificial Sequence: Synthetic oligonucleotide"
ccagugacaaugaccgccuuu

SEQ ID NO: 321 - RNA, 21 nt, Artificial Sequence
  source: /note="Description of Artificial Sequence: Synthetic oligonucleotide"
cagugacaaugaccgccuguu

SEQ ID NO: 322 - RNA, 21 nt, Artificial Sequence
  source: /note="Description of Artificial Sequence: Synthetic oligonucleotide"
agugacaaugaccgccugcuu

SEQ ID NO: 323 - RNA, 21 nt, Artificial Sequence
  source: /note="Description of Artificial Sequence: Synthetic oligonucleotide"
gugacaaugaccgccugcguu

SEQ ID NO: 324 - RNA, 21 nt, Artificial Sequence
  source: /note="Description of Artificial Sequence: Synthetic oligonucleotide"
ugacaaugaccgccugcgcuu

SEQ ID NO: 325 - RNA, 21 nt, Artificial Sequence
  source: /note="Description of Artificial Sequence: Synthetic oligonucleotide"
gacaaugaccgccugcgcauu

SEQ ID NO: 326 - RNA, 21 nt, Artificial Sequence
  source: /note="Description of Artificial Sequence: Synthetic oligonucleotide"
acaaugaccgccugcgcaauu

SEQ ID NO: 327 - RNA, 21 nt, Artificial Sequence
  source: /note="Description of Artificial Sequence: Synthetic oligonucleotide"
ccccgcgaggaggaugaauuu

SEQ ID NO: 328 - RNA, 21 nt, Artificial Sequence
  source: /note="Description of Artificial Sequence: Synthetic oligonucleotide"
cccgcgaggaggaugaaucuu

SEQ ID NO: 329 - RNA, 21 nt, Artificial Sequence
  source: /note="Description of Artificial Sequence: Synthetic oligonucleotide"
ccgcgaggaggaugaauccuu

SEQ ID NO: 330 - RNA, 21 nt, Artificial Sequence
  source: /note="Description of Artificial Sequence: Synthetic oligonucleotide"
cgcgaggaggaugaauccuuu

SEQ ID NO: 331 - RNA, 21 nt, Artificial Sequence
  source: /note="Description of Artificial Sequence: Synthetic oligonucleotide"
gcgaggaggaugaauccuuuu

SEQ ID NO: 332 - RNA, 21 nt, Artificial Sequence
  source: /note="Description of Artificial Sequence: Synthetic oligonucleotide"
cgaggaggaugaauccuuuuu

SEQ ID NO: 333 - RNA, 21 nt, Artificial Sequence
  source: /note="Description of Artificial Sequence: Synthetic oligonucleotide"
aggaggaugaauccuuucauu

SEQ ID NO: 334 - RNA, 21 nt, Artificial Sequence
  source: /note="Description of Artificial Sequence: Synthetic oligonucleotide"
ggaggaugaauccuuucaguu

SEQ ID NO: 335 - RNA, 21 nt, Artificial Sequence
  source: /note="Description of Artificial Sequence: Synthetic oligonucleotide"
gaggaugaauccuuucagcuu

SEQ ID NO: 336 - RNA, 21 nt, Artificial Sequence
  source: /note="Description of Artificial Sequence: Synthetic oligonucleotide"
aggaugaauccuuucagcuuu

SEQ ID NO: 337 - RNA, 21 nt, Artificial Sequence
  source: /note="Description of Artificial Sequence: Synthetic oligonucleotide"
ggaugaauccuuucagcuguu

SEQ ID NO: 338 - RNA, 21 nt, Artificial Sequence
  source: /note="Description of Artificial Sequence: Synthetic oligonucleotide"
gaugaauccuuucagcugguu

SEQ ID NO: 339 - RNA, 21 nt, Artificial Sequence
  source: /note="Description of Artificial Sequence: Synthetic oligonucleotide"
augaauccuuucagcuggcuu

SEQ ID NO: 340 - RNA, 21 nt, Artificial Sequence
  source: /note="Description of Artificial Sequence: Synthetic oligonucleotide"
ugaauccuuucagcuggcguu

SEQ ID NO: 341 - RNA, 21 nt, Artificial Sequence
  source: /note="Description of Artificial Sequence: Synthetic oligonucleotide"
gaauccuuucagcuggcgcuu

SEQ ID NO: 342 - RNA, 21 nt, Artificial Sequence
  source: /note="Description of Artificial Sequence: Synthetic oligonucleotide"
aauccuuucagcuggcgcuuu

SEQ ID NO: 343 - RNA, 21 nt, Artificial Sequence
  source: /note="Description of Artificial Sequence: Synthetic oligonucleotide"
auccuuucagcuggcgcuguu

SEQ ID NO: 344 - RNA, 21 nt, Artificial Sequence
  source: /note="Description of Artificial Sequence: Synthetic oligonucleotide"
uccuuucagcuggcgcugguu

SEQ ID NO: 345 - RNA, 21 nt, Artificial Sequence
  source: /note="Description of Artificial Sequence: Synthetic oligonucleotide"
ccuuucagcuggcgcuggcuu

SEQ ID NO: 346 - RNA, 21 nt, Artificial Sequence
  source: /note="Description of Artificial Sequence: Synthetic oligonucleotide"
cuuucagcuggcgcuggccuu

SEQ ID NO: 347 - RNA, 21 nt, Artificial Sequence
  source: /note="Description of Artificial Sequence: Synthetic oligonucleotide"
ccccgcgaggaggaugaaguu

SEQ ID NO: 348 - RNA, 21 nt, Artificial Sequence
  source: /note="Description of Artificial Sequence: Synthetic oligonucleotide"
ccgcgaggaggaugaagccuu

SEQ ID NO: 349 - RNA, 21 nt, Artificial Sequence
  source: /note="Description of Artificial Sequence: Synthetic oligonucleotide"
aggaugaagccaagcagcuuu

SEQ ID NO: 350 - RNA, 21 nt, Artificial Sequence
  source: /note="Description of Artificial Sequence: Synthetic oligonucleotide"
ugaagccaagcagcuggcguu

SEQ ID NO: 351 - RNA, 21 nt, Artificial Sequence
  source: /note="Description of Artificial Sequence: Synthetic oligonucleotide"
aagccaagcagcuggcgcuuu

SEQ ID NO: 352 - RNA, 21 nt, Artificial Sequence
  source: /note="Description of Artificial Sequence: Synthetic oligonucleotide"
  modified_base (2)..(2): 2'-OMe modified nucleotide
  modified_base (7)..(7): 2'-OMe modified nucleotide
  modified_base (9)..(9): 2'-OMe modified nucleotide
  modified_base (14)..(14): 2'-OMe modified nucleotide
  misc_feature (19)..(21): /note="Phosphorothioate linkages"
  modified_base (19)..(21): 2'-OMe modified nucleotide
ucgaaguacucagcguaaguu

SEQ ID NO: 353 - DNA, 21 bp, Artificial Sequence
  source: /note="Description of Artificial Sequence: Synthetic oligonucleotide"
  source: /note="Description of Combined DNA/RNA Molecule: Synthetic oligonucleotide"
  modified_base (3)..(3): 2'-OMe modified nucleotide
  modified_base (10)..(10): 2'-OMe modified nucleotide
  modified_base (15)..(15): 2'-OMe modified nucleotide
  misc_feature (20)..(21): /note="Phosphorothioate linkages"
acuaaucuccacuucaucctt

SEQ ID NO: 354 - RNA, 21 nt, Artificial Sequence
  source: /note="Description of Artificial Sequence: Synthetic oligonucleotide"
  modified_base (1)..(1): Inverted abasic modification
gcggucauugucacuggucuu

SEQ ID NO: 355 - RNA, 21 nt, Artificial Sequence
  source: /note="Description of Artificial Sequence: Synthetic oligonucleotide"
  modified_base (1)..(1): Inverted abasic modification
ugaaaggauucauccuccuuu

SEQ ID NO: 356 - RNA, 21 nt, Artificial Sequence
  source: /note="Description of Artificial Sequence: Synthetic oligonucleotide"
  modified_base (1)..(1): Inverted abasic modification
cugaaaggauucauccuccuu

SEQ ID NO: 357 - RNA, 21 nt, Artificial Sequence
  source: /note="Description of Artificial Sequence: Synthetic oligonucleotide"
  modified_base (1)..(1): Inverted abasic modification
ggccagcgccagcugaaaguu

SEQ ID NO: 358 - RNA, 21 nt, Artificial Sequence
  source: /note="Description of Artificial Sequence: Synthetic oligonucleotide"
  modified_base (1)..(1): Inverted abasic modification
  modified_base (2)..(2): 2'-OMe modified nucleotide
  modified_base (4)..(4): 2'-OMe modified nucleotide
  modified_base (6)..(6): 2'-OMe modified nucleotide
  modified_base (8)..(8): 2'-OMe modified nucleotide
  modified_base (10)..(10): 2'-OMe modified nucleotide
  modified_base (12)..(12): 2'-OMe modified nucleotide
  modified_base (14)..(14): 2'-OMe modified nucleotide
  modified_base (16)..(16): 2'-OMe modified nucleotide
  modified_base (19)..(21): 2'-OMe modified nucleotide
cggucauugucacuggucauu

SEQ ID NO: 359 - RNA, 21 nt, Artificial Sequence
  source: /note="Description of Artificial Sequence: Synthetic oligonucleotide"
  modified_base (1)..(1): Inverted abasic modification
  modified_base (3)..(3): 2'-OMe modified nucleotide
  modified_base (5)..(5): 2'-OMe modified nucleotide
  modified_base (7)..(7): 2'-OMe modified nucleotide
  modified_base (9)..(9): 2'-OMe modified nucleotide
  modified_base (11)..(11): 2'-OMe modified nucleotide
  modified_base (13)..(13): 2'-OMe modified nucleotide
  modified_base (15)..(15): 2'-OMe modified nucleotide
  modified_base (17)..(17): 2'-OMe modified nucleotide
  modified_base (20)..(21): 2'-OMe modified nucleotide
gcggucauugucacuggucuu

SEQ ID NO: 360 - RNA, 21 nt, Artificial Sequence
  source: /note="Description of Artificial Sequence: Synthetic oligonucleotide"
  modified_base (1)..(1): Inverted abasic modification
  modified_base (2)..(2): 2'-OMe modified nucleotide
  modified_base (4)..(4): 2'-OMe modified nucleotide
  modified_base (6)..(6): 2'-OMe modified nucleotide
  modified_base (8)..(8): 2'-OMe modified nucleotide
  modified_base (10)..(10): 2'-OMe modified nucleotide
  modified_base (13)..(13): 2'-OMe modified nucleotide
  modified_base (16)..(16): 2'-OMe modified nucleotide
  modified_base (19)..(21): 2'-OMe modified nucleotide
ugaaaggauucauccuccuuu

SEQ ID NO: 361 - RNA, 21 nt, Artificial Sequence
  source: /note="Description of Artificial Sequence: Synthetic oligonucleotide"
  modified_base (1)..(1): Inverted abasic modification
  modified_base (2)..(2): 2'-OMe modified nucleotide
  modified_base (4)..(4): 2'-OMe modified nucleotide
  modified_base (6)..(6): 2'-OMe modified nucleotide
  modified_base (8)..(8): 2'-OMe modified nucleotide
  modified_base (10)..(11): 2'-OMe modified nucleotide
  modified_base (14)..(14): 2'-OMe modified nucleotide
  modified_base (17)..(17): 2'-OMe modified nucleotide
  modified_base (20)..(21): 2'-OMe modified nucleotide
cugaaaggauucauccuccuu

SEQ ID NO: 362 - RNA, 21 nt, Artificial Sequence
  source: /note="Description of Artificial Sequence: Synthetic oligonucleotide"
  modified_base (1)..(1): Inverted abasic modification
  modified_base (2)..(2): 2'-OMe modified nucleotide
  modified_base (6)..(6): 2'-OMe modified nucleotide
  modified_base (8)..(8): 2'-OMe modified nucleotide
  modified_base (12)..(12): 2'-OMe modified nucleotide
  modified_base (14)..(14): 2'-OMe modified nucleotide
  modified_base (16)..(16): 2'-OMe modified nucleotide
  modified_base (18)..(18): 2'-OMe modified nucleotide
  modified_base (20)..(21): 2'-OMe modified nucleotide
ggccagcgccagcugaaaguu

SEQ ID NO: 363 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(4): 2'-OMe modified nucleotide
  modified_base (10)..(10): 2'-OMe modified nucleotide
  modified_base (14)..(14): 2'-OMe modified nucleotide
  modified_base (20)..(21): 2'-OMe modified nucleotide
cggucauugucacuggucauu

SEQ ID NO: 364 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(4): 2'-OMe modified nucleotide
  modified_base (10)..(10): 2'-OMe modified nucleotide
  modified_base (14)..(14): 2'-OMe modified nucleotide
  modified_base (20)..(21): 2'-OMe modified nucleotide
gcggucauugucacuggucuu

SEQ ID NO: 365 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(4): 2'-OMe modified nucleotide
  modified_base (10)..(10): 2'-OMe modified nucleotide
  modified_base (14)..(14): 2'-OMe modified nucleotide
  modified_base (20)..(21): 2'-OMe modified nucleotide
ugaaaggauucauccuccuuu

SEQ ID NO: 366 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(4): 2'-OMe modified nucleotide
  modified_base (10)..(10): 2'-OMe modified nucleotide
  modified_base (14)..(14): 2'-OMe modified nucleotide
  modified_base (20)..(21): 2'-OMe modified nucleotide
cugaaaggauucauccuccuu

SEQ ID NO: 367 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(4): 2'-OMe modified nucleotide
  modified_base (10)..(10): 2'-OMe modified nucleotide
  modified_base (14)..(14): 2'-OMe modified nucleotide
  modified_base (20)..(21): 2'-OMe modified nucleotide
ggccagcgccagcugaaaguu

SEQ ID NO: 368 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (4)..(5): 2'-OMe modified nucleotide
  modified_base (7)..(8): 2'-OMe modified nucleotide
  modified_base (10)..(11): 2'-OMe modified nucleotide
  modified_base (13)..(14): 2'-OMe modified nucleotide
  modified_base (17)..(18): 2'-OMe modified nucleotide
  modified_base (20)..(21): 2'-OMe modified nucleotide
cggucauugucacuggucauu

SEQ ID NO: 369 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (5)..(6): 2'-OMe modified nucleotide
  modified_base (8)..(9): 2'-OMe modified nucleotide
  modified_base (11)..(12): 2'-OMe modified nucleotide
  modified_base (14)..(15): 2'-OMe modified nucleotide
  modified_base (18)..(21): 2'-OMe modified nucleotide
gcggucauugucacuggucuu

SEQ ID NO: 370 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (9)..(11): 2'-OMe modified nucleotide
  modified_base (13)..(21): 2'-OMe modified nucleotide
ugaaaggauucauccuccuuu

SEQ ID NO: 371 - RNA, 21 nt, Artificial Sequence
  source: /note="Description of Artificial Sequence: Synthetic oligonucleotide"
  modified_base (1)..(1): Inverted abasic modification
  modified_base (1)..(2): 2'-OMe modified nucleotide
  modified_base (10)..(12): 2'-OMe modified nucleotide
  modified_base (14)..(21): 2'-OMe modified nucleotide
cugaaaggauucauccuccuu

SEQ ID NO: 372 - RNA, 21 nt, Artificial Sequence
  source: /note="Description of Artificial Sequence: Synthetic oligonucleotide"
  modified_base (1)..(1): Inverted abasic modification
  modified_base (1)..(4): 2'-OMe modified nucleotide
  modified_base (7)..(7): 2'-OMe modified nucleotide
  modified_base (9)..(10): 2'-OMe modified nucleotide
  modified_base (13)..(14): 2'-OMe modified nucleotide
  modified_base (20)..(21): 2'-OMe modified nucleotide
ggccagcgccagcugaaaguu

SEQ ID NO: 373 - RNA, 21 nt, Artificial Sequence
  source: /note="Description of Artificial Sequence: Synthetic oligonucleotide"
  modified_base (20)..(21): 2'-OMe modified nucleotide
ugaccagugacaaugaccguu

SEQ ID NO: 374 - RNA, 21 nt, Artificial Sequence
  source: /note="Description of Artificial Sequence: Synthetic oligonucleotide"
  modified_base (20)..(21): 2'-OMe modified nucleotide
gaccagugacaaugaccgcuu

SEQ ID NO: 375 - RNA, 21 nt, Artificial Sequence
  source: /note="Description of Artificial Sequence: Synthetic oligonucleotide"
  modified_base (20)..(21): 2'-OMe modified nucleotide
aggaggaugaauccuuucauu

SEQ ID NO: 376 - RNA, 21 nt, Artificial Sequence
  source: /note="Description of Artificial Sequence: Synthetic oligonucleotide"
  modified_base (20)..(21): 2'-OMe modified nucleotide
ggaggaugaauccuuucaguu

SEQ ID NO: 377 - RNA, 21 nt, Artificial Sequence
  source: /note="Description of Artificial Sequence: Synthetic oligonucleotide"
  modified_base (20)..(21): 2'-OMe modified nucleotide
cuuucagcuggcgcuggccuu

SEQ ID NO: 378 - RNA, 21 nt, Artificial Sequence
  source: /note="Description of Artificial Sequence: Synthetic oligonucleotide"
  modified_base (5)..(5): 2'-OMe modified nucleotide
  modified_base (11)..(11): 2'-OMe modified nucleotide
  modified_base (20)..(21): 2'-OMe modified nucleotide
ugaccagugacaaugaccguu

SEQ ID NO: 379 - RNA, 21 nt, Artificial Sequence
  source: /note="Description of Artificial Sequence: Synthetic oligonucleotide"
  modified_base (4)..(4): 2'-OMe modified nucleotide
  modified_base (10)..(10): 2'-OMe modified nucleotide
  modified_base (20)..(21): 2'-OMe modified nucleotide
gaccagugacaaugaccgcuu

SEQ ID NO: 380 - RNA, 21 nt, Artificial Sequence
  source: /note="Description of Artificial Sequence: Synthetic oligonucleotide"
  modified_base (18)..(18): 2'-OMe modified nucleotide
  modified_base (20)..(21): 2'-OMe modified nucleotide
aggaggaugaauccuuucauu

SEQ ID NO: 381 - RNA, 21 nt, Artificial Sequence
  source: /note="Description of Artificial Sequence: Synthetic oligonucleotide"
  modified_base (17)..(17): 2'-OMe modified nucleotide
  modified_base (20)..(21): 2'-OMe modified nucleotide
ggaggaugaauccuuucaguu

SEQ ID NO: 382 - RNA, 21 nt, Artificial Sequence
  source: /note="Description of Artificial Sequence: Synthetic oligonucleotide"
  modified_base (5)..(5): 2'-OMe modified nucleotide
  modified_base (20)..(21): 2'-OMe modified nucleotide
cuuucagcuggcgcuggccuu

SEQ ID NO: 383 - DNA, 297 bp, Artificial Sequence
  source: /note="Description of Artificial Sequence: Synthetic polynucleotide"
gcggccgcttgtttgaatgaggcttcagtactttacagaatcgttgcctgcacatcttggaaacacttgctgggattacttcttcaggttaacccaacagaaggctcgagaaggtatattgctgttgacagtgagcgcggcggtcattgtcactggtcatagtgaagccacagatgtatgaccagtgacaatgaccgccttgcctactgcctcggaattcaaggggctactttaggagcaattatcttgtttactaaaactgaataccttgctatctctttgatacattggcgcgcc

SEQ ID NO: 384 - RNA, 97 nt, Artificial Sequence
  source: /note="Description of Artificial Sequence: Synthetic oligonucleotide"
ugcuguugacagugagcgcggcggucauugucacuggucauagugaagccacagauguaugaccagugacaaugaccgccuugccuacugccucgga

SEQ ID NO: 385 - RNA, 19 nt, Artificial Sequence
  source: /note="Description of Artificial Sequence: Synthetic oligonucleotide"
gaccagugacaaugaccgc

The invention claimed is:

1. A synthetic short activating RNA (saRNA) which up-regulates the expression of a target gene, wherein the target gene is CCAAT/enhancer-binding protein alpha (CEBPA), wherein the saRNA comprises an anti-sense strand of 19-21 nucleotides, wherein the antisense strand comprises a sequence of GACCAGUGACAAUGACCGC (SEQ ID No: 385), and wherein the antisense strand comprises at least one unpaired nucleotide at the 3' end forming 3' overhangs.

2. The saRNA of claim 1, wherein the antisense strand comprises 2 unpaired nucleotides at the 3' end forming 3' overhangs.

3. The saRNA of claim 1, wherein the antisense strand comprises at least one chemical modification.

4. The saRNA of claim 1, wherein the antisense strand has a sequence of SEQ ID No: 318 or 374.

5. The saRNA of claim 1, wherein the saRNA is double stranded and further comprises a sense strand.

6. The saRNA of claim 5, wherein the sense strand comprises at least one chemical modification.

7. The saRNA of claim 5, wherein the sense strand has a sequence selected from SEQ ID No: 280 or 364.

8. The saRNA of claim 1, wherein the saRNA is double stranded and further comprises a sense strand, wherein the antisense strand comprises SEQ ID No. 318 and the sense strand comprises SEQ ID No. 280.

9. The saRNA of claim 1, wherein the saRNA is double stranded and further comprises a sense strand, wherein the antisense strand comprises SEQ ID No. 374 and the sense strand comprises SEQ ID No. 364.

10. The saRNA of claim 1, wherein the unpaired nucleotide is a uracil.

11. The saRNA of claim 2, wherein the unpaired nucleotides are uracils.

* * * * *